US009481725B2

(12) United States Patent
Dutzar et al.

(10) Patent No.: US 9,481,725 B2
(45) Date of Patent: Nov. 1, 2016

(54) ANTIBODIES TO HGF AND COMPOSITIONS CONTAINING

(71) Applicant: ALDERBIO HOLDINGS LLC, Las Vegas, NV (US)

(72) Inventors: Benjamin H. Dutzar, Seattle, WA (US); Katie Anderson, Kirkland, WA (US); Brian R. Kovacevich, Snohomish, WA (US); Andrew L. Feldhaus, Lynnwood, WA (US); John A. Latham, Seattle, WA (US); Leon F. Garcia-Martinez, Woodinville, WA (US)

(73) Assignee: ALDERBIO HOLDINGS, LLC, Las Vegas, NV (US)

( * ) Notice: Subject to any disclaimer, the term of this patent is extended or adjusted under 35 U.S.C. 154(b) by 0 days.

(21) Appl. No.: 14/212,189

(22) Filed: Mar. 14, 2014

(65) Prior Publication Data

US 2014/0271459 A1     Sep. 18, 2014

Related U.S. Application Data

(60) Provisional application No. 61/782,868, filed on Mar. 14, 2013.

(51) Int. Cl.
| *C07K 16/22* | (2006.01) |
| *A61K 39/395* | (2006.01) |
| *A61K 39/00* | (2006.01) |

(52) U.S. Cl.
CPC ......... *C07K 16/22* (2013.01); *A61K 2039/505* (2013.01); *C07K 2317/55* (2013.01); *C07K 2317/73* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| 7,408,043 B2 * | 8/2008 | Chung et al. ............... 530/388.1 |
| 7,649,083 B2 * | 1/2010 | Winston et al. ......... 530/388.24 |
| 7,718,174 B2 | 5/2010 | Chung et al. |
| 8,323,649 B2 | 12/2012 | Garcia-Martinez et al. |
| 2010/0129357 A1 | 5/2010 | Garcia-Martinez et al. |
| 2013/0344068 A1 | 12/2013 | Garcia-Martinez et al. |

OTHER PUBLICATIONS

Burgess T, et al. "Fully human monoclonal antibodies to hepatocyte growth factor with therapeutic potential against hepatocyte growth factor/c-Met-dependent human tumors," Cancer Res. Feb. 1, 2006;66(3):1721-9.

* cited by examiner

*Primary Examiner* — Marianne P Allen
(74) *Attorney, Agent, or Firm* — Robin L. Teskin; LeClairRyan A Professional Corporation

(57) ABSTRACT

The present invention is directed to antibodies and fragments thereof having binding specificity for HGF. Another embodiment of this invention relates to the antibodies described herein, and binding fragments thereof, comprising the sequences of the $V_H$, $V_L$ and CDR polypeptides described herein, and the polynucleotides encoding them. The invention also contemplates conjugates of anti-HGF antibodies and binding fragments thereof conjugated to one or more functional or detectable moieties. The invention also contemplates methods of making said anti-HGF antibodies and binding fragments thereof. Embodiments of the invention also pertain to the use of anti-HGF antibodies, and binding fragments thereof, for the diagnosis, assessment and treatment of diseases and disorders associated with HGF.

11 Claims, 99 Drawing Sheets

Figure 52A
Antibody Heavy chain Protein features

| Sequence Name | FR1 | CDR1 | FR2 | CDR2 |
|---|---|---|---|---|
| Ab1 | QSVEESGGRLVTPGTPLTLTCTVSGFSLS | AYAMS | WVRQAPEKGLEWIA | VIYVIGATDYASWAKG |
| Ab2 | EVQLVESGGGLVQPGGSLRLSCAASGFTVS | AYAMS | WVRQAPGKGLEWVA | VIYVIGATDYASSAKG |
| Ab3 | QSVEESGGRLVTPGTPLTLTCTVSGLTIS | SYYMS | WVRQAPGKGLEWIG | TINPGANTYFASWAKG |
| Ab4 | QSLEESGGRLVQPGTPLTLSCTASGLTIS | SYYMS | WVRQAPGKGLEWIG | TINPGANTYFASSAKG |
| Ab5 | QSLEESGGRLVTPGTPLTLTCTVSGFSLN | NYAVG | WVRQAPGKGLEWIG | IIYLSGNTDYANWAKG |
| Ab6 | QSVEESGGRLVMPGTPLTLTCTVSGFSLS | SNAIS | WVRQAPEKGLEWIG | VIYVIGVTDYASWAQG |
| Ab7 | QSVEESGGRLVMPGTPLTLTCTVSGFSLS | SNAIS | WVRQAPEKGLEWIG | VIYVIGVTDYASWAQG |
| Ab8 | EVQLVESGGGLVQPGGSLRLSCAASGFTVS | SNGMS | WVRQAPGKGLEWVG | VIYVIGVTDYASSAQG |
| Ab9 | QSVEESGGRLVTPGTPLTLTCTVSGIDLN | SNGMS | WVRQAPGEGLEWVG | ASSIDGTTYYTNWAKG |
| Ab10 | EVQLVESGGGLVQPGGSLRLSCAASGFTVS | DYALS | WVRQAPGKGLEWVG | ASSIDGTTYYTNSAKG |
| Ab11 | QSMEESGGRLVTPGTPLTLTCTVSGFSLS | SNAIS | WVRQAPEKGLEWIA | MISSGDNTYYASWAKG |
| Ab12 | QSLEESGGRLVTPGGSLTLTCTVSGIDLS | SNAIS | WVRQAPGKGLEWIG | VIYVVGATDYASWAKG |
| Ab13 | EVQLVESGGGLVQPGGSLRLSCAASGFTVS | NYAMT | WVRQAPGKGLEWVA | VIYVVGATDYASSAKG |
| Ab14 | QSVEESGGRLVTPGTPLTLTCTVSGFSLS | NYAMT | WVRQAPGKGLEWIG | VISFGGNTYYANWAKG |
| Ab15 | QSVEESGGRLVTPGTPLTLTCTVSGFSLS | NYAMG | WVRQAPGKGLEWIG | VISFGGNTYYANWAKG |
| Ab16 | QSVEESGGRLVTPGTPLTLTCTVSGIDLS | SYAMG | WVRQAPGKGLEYIG | MIGVNGRAWYATWAKG |
| Ab17 | QSVEESGGRLVPPGTPLTLTCTVSGIDLS | SYDMS | WVRQAPGKGLEYIG | MIDVSGSTYYADWAKG |
| Ab18 | QSLEESGGRLVTPGTPLTLTCTASGFSLS | NYWMG | WVRQAPGKGLEWIG | IIYAGSASTWFASWVKG |
| Ab19 | QSVEESGGRLVTPGTPLTLTCTASGFSLS | NYWMG | WVRQAPGEGLEWIG | TISYDGNTYYASWAKG |
| Ab20 | EVQLVESGGGLVQPGGSLRLSCAASGFTVS | TYYMS | WVRQAPGKGLEWIG | TISYDGNTYYASSAKG |
| Ab21 | QSVEESGGRLVTPGTPLTLTCTVSGFSLS | RYYMS | WVRQAPGKGLEWIG | IIYVSGITDYARWAKG |
| Ab23 | QSLEESGGRLVTPGTPLTLTCTASGFTIG | RYYMS | WVRQAPGKGLEWIG | IIYTHGVNPDYASWAKG |
| Ab24 | EVQLVESGGGLVQPGGSLRLSCAASGFTVG | SYAMG | WVRQAPGKGLEWIG | IIYTHGVNPDYASSAKG |
| Ab25 | QSLEESGGRLVTPGTPLTLTCTASGFSLS | TYTMN | WFRQAPGKGLEWIA | YIFASGSTYYASWAKG |
| Ab26 | QSVEESGGRLVTPGTPLTLTCTVSGFSLS | DDHYMC | WVRQAPGKGLEYIG | FISSSSIDYVSWAKG |
| Ab27 | QSLEESGGDLVKPGGTLTLTCTASGFSFS | SNAIS | WVRQAPGKGLQWIA | CMYVGSSGATYYASWAKG |
| Ab28 | EVQLVESGGGLVQPGGSLRLSCAASGFTVS | SNAIS | WVRQAPGKGLEWVG | VIYVIGVTDYASSAQG |

Figure 52B
Antibody Heavy chain Protein features

| Sequence Name | FR3 | CDR3 | FR4 |
|---|---|---|---|
| Ab1 | RFTISRTSTTVDLRIPSPTTEDTATYFCAR | VYDSVWNHFNL | WGPGTLVTVSS |
| Ab2 | RFTISRDNSKNTLYLQMNSLRAEDTAVYCAR | VYDSVWNHFNL | WGQGTLVTVSS |
| Ab3 | RFTISRTSTTVDLKITSPTTEDTATYFCAR | EGDSNDWGVFDL | WGQGTLVTVSS |
| Ab4 | RFTISRSTTLDLKMTSPTAEDTATYCAR | EGDSNDWGVFDL | WGQGTLVTVSS |
| Ab5 | RFTISKTSTTVDLKITSPTTEDTATYFCAR | KFDTGYDI | WGPGTLVTVSS |
| Ab6 | RFTISKTSTTVDLKIPSPTTEDTATYFCAR | VYDSGWNHFNL | WGPGTLVTVSS |
| Ab7 | RFTISKTSTTVDLKIPSPTTEDTATYFCAR | VYDSGWNHFNL | WGPGTLVTVSS |
| Ab8 | RFTISRDNSKNTLYLQMNSLRAEDTAVYYCAR | VYDSGWNHFNL | WGQGTLVTVSS |
| Ab9 | RFTISKTSSTTVDLKITSPTTEDTATYFCTR | GEYAGVVGSNYFDL | WGQGTLVTVSS |
| Ab10 | RFTISRDNSKNTLYLQMNSLRAEDTAVYYCAR | GEYAGVVGSNYFDL | WGQGTLVTVSS |
| Ab11 | RFTISKASTTVDLKITSPTTEDTATYFCAR | DKDASSGGYLVLDLLDVPDGMDL | WGPGTLVTVSS |
| Ab12 | RFTISRTSTTVDLKMTSLTTEDTATYFCAR | VYDSGWNHFNL | WGQGTLVTVSS |
| Ab13 | RFTISRDNSKNTLYLQMNSLRAEDTAVYYCAR | VYDSGWNHFNL | WGQGTLVTVSS |
| Ab14 | RFTISKTSTTVDLKITSPTTEDTATYFCAR | WDAENNEILNL | WGQGTLVTVSS |
| Ab15 | RFTISKTSTTVDLKITSPTTEDTATYFCAR | WDAENNEILNL | WGPGTLVTVSS |
| Ab16 | RFTISKTSPTVDLKITSPTTEDTATYFCAR | LIDERSTYSYVFDL | WGQGTLVTVSS |
| Ab17 | RLTISKTPTTVDLEITSPTTEDTATYFCAR | LIDERSTYSYAFDL | WGQGTLVTVSS |
| Ab18 | RFTISKTSTTVDLKMTSLTTEDTATYFCAR | VGYSGYGYDDNLDM | WGQGTLVTVSS |
| Ab19 | RFTISRTSTTVDLKMTSLTTEDTAIYFCAT | VNYPDYSTGAFNI | WGPGTLVTVSS |
| Ab20 | RFTISRDNSKNTLYLQMNSLRAEDTAVYYCAT | VNYPDYSTGAFNI | WGQGTLVTVSS |
| Ab21 | RFTISKTSTTVDLKMTSLTTEDTATYFCAR | HIDSSGWDGLGI | WGQGTLVTVSS |
| Ab23 | RFTISRPSTTVDLKITSPTTEDTATYFCAR | VGGFNDYSDI | WGPGTLVTVSS |
| Ab24 | RFTISRDNSKNTLYLQMNSLRAEDTAVYYCAR | VGGFNDYSDI | WGQGTLVTVSS |
| Ab25 | RFTISKTSTTVELKITSLTTEDTATYFCAR | GSGARFFPNYFAI | WGPGTLVTVSS |
| Ab26 | RFTISKTSTTVDLKITSPTTEDTATYFCAR | DFYADYIGGGYPYI | WGPGTLVTVSS |
| Ab27 | RFTISKTSSTTVTLQMTSLTAADTATYFCAR | DDWTSYYAWGYWAL | WGPGTLVTVSS |
| Ab28 | RFTISRDNSKNTLYLQMNSLRAEDTAVYYCAR | VYDSGWNHFNL | WGQGTLVTVSS |

Figure 52C
Antibody Heavy chain Protein features

| Sequence Name | Constant region |
|---|---|
| Ab1 | ASTKGPSVFPLAPSSKSTSGGTAALGCLVKDYFPEPVTVSWNSGALTSGVHTFPAVLQSSGLYSLSSVVTVPSSSL |
| Ab2 | ASTKGPSVFPLAPSSKSTSGGTAALGCLVKDYFPEPVTVSWNSGALTSGVHTFPAVLQSSGLYSLSSVVTVPSSSL |
| Ab3 | ASTKGPSVFPLAPSSKSTSGGTAALGCLVKDYFPEPVTVSWNSGALTSGVHTFPAVLQSSGLYSLSSVVTVPSSSL |
| Ab4 | ASTKGPSVFPLAPSSKSTSGGTAALGCLVKDYFPEPVTVSWNSGALTSGVHTFPAVLQSSGLYSLSSVVTVPSSSL |
| Ab5 | ASTKGPSVFPLAPSSKSTSGGTAALGCLVKDYFPEPVTVSWNSGALTSGVHTFPAVLQSSGLYSLSSVVTVPSSSL |
| Ab6 | ASTKGPSVFPLAPSSKSTSGGTAALGCLVKDYFPEPVTVSWNSGALTSGVHTFPAVLQSSGLYSLSSVVTVPSSSL |
| Ab7 | ASTKGPSVFPLAPSSKSTSGGTAALGCLVKDYFPEPVTVSWNSGALTSGVHTFPAVLQSSGLYSLSSVVTVPSSSL |
| Ab8 | ASTKGPSVFPLAPSSKSTSGGTAALGCLVKDYFPEPVTVSWNSGALTSGVHTFPAVLQSSGLYSLSSVVTVPSSSL |
| Ab9 | ASTKGPSVFPLAPSSKSTSGGTAALGCLVKDYFPEPVTVSWNSGALTSGVHTFPAVLQSSGLYSLSSVVTVPSSSL |
| Ab10 | ASTKGPSVFPLAPSSKSTSGGTAALGCLVKDYFPEPVTVSWNSGALTSGVHTFPAVLQSSGLYSLSSVVTVPSSSL |
| Ab11 | ASTKGPSVFPLAPSSKSTSGGTAALGCLVKDYFPEPVTVSWNSGALTSGVHTFPAVLQSSGLYSLSSVVTVPSSSL |
| Ab12 | ASTKGPSVFPLAPSSKSTSGGTAALGCLVKDYFPEPVTVSWNSGALTSGVHTFPAVLQSSGLYSLSSVVTVPSSSL |
| Ab13 | ASTKGPSVFPLAPSSKSTSGGTAALGCLVKDYFPEPVTVSWNSGALTSGVHTFPAVLQSSGLYSLSSVVTVPSSSL |
| Ab14 | ASTKGPSVFPLAPSSKSTSGGTAALGCLVKDYFPEPVTVSWNSGALTSGVHTFPAVLQSSGLYSLSSVVTVPSSSL |
| Ab15 | ASTKGPSVFPLAPSSKSTSGGTAALGCLVKDYFPEPVTVSWNSGALTSGVHTFPAVLQSSGLYSLSSVVTVPSSSL |
| Ab16 | ASTKGPSVFPLAPSSKSTSGGTAALGCLVKDYFPEPVTVSWNSGALTSGVHTFPAVLQSSGLYSLSSVVTVPSSSL |
| Ab17 | ASTKGPSVFPLAPSSKSTSGGTAALGCLVKDYFPEPVTVSWNSGALTSGVHTFPAVLQSSGLYSLSSVVTVPSSSL |
| Ab18 | ASTKGPSVFPLAPSSKSTSGGTAALGCLVKDYFPEPVTVSWNSGALTSGVHTFPAVLQSSGLYSLSSVVTVPSSSL |
| Ab19 | ASTKGPSVFPLAPSSKSTSGGTAALGCLVKDYFPEPVTVSWNSGALTSGVHTFPAVLQSSGLYSLSSVVTVPSSSL |
| Ab20 | ASTKGPSVFPLAPSSKSTSGGTAALGCLVKDYFPEPVTVSWNSGALTSGVHTFPAVLQSSGLYSLSSVVTVPSSSL |
| Ab21 | ASTKGPSVFPLAPSSKSTSGGTAALGCLVKDYFPEPVTVSWNSGALTSGVHTFPAVLQSSGLYSLSSVVTVPSSSL |
| Ab23 | ASTKGPSVFPLAPSSKSTSGGTAALGCLVKDYFPEPVTVSWNSGALTSGVHTFPAVLQSSGLYSLSSVVTVPSSSL |
| Ab24 | ASTKGPSVFPLAPSSKSTSGGTAALGCLVKDYFPEPVTVSWNSGALTSGVHTFPAVLQSSGLYSLSSVVTVPSSSL |
| Ab25 | ASTKGPSVFPLAPSSKSTSGGTAALGCLVKDYFPEPVTVSWNSGALTSGVHTFPAVLQSSGLYSLSSVVTVPSSSL |
| Ab26 | ASTKGPSVFPLAPSSKSTSGGTAALGCLVKDYFPEPVTVSWNSGALTSGVHTFPAVLQSSGLYSLSSVVTVPSSSL |
| Ab27 | ASTKGPSVFPLAPSSKSTSGGTAALGCLVKDYFPEPVTVSWNSGALTSGVHTFPAVLQSSGLYSLSSVVTVPSSSL |
| Ab28 | ASTKGPSVFPLAPSSKSTSGGTAALGCLVKDYFPEPVTVSWNSGALTSGVHTFPAVLQSSGLYSLSSVVTVPSSSL |

Figure 52D
Antibody Heavy chain Protein features

| Sequence Name | Constant region |
|---|---|
| Ab1 | GTQTYICNVNHKPSNTKVDKRVEPKSCDKTHTCPPCPAPELLGGPSVFLFPPKPKDTLMISRTPEVTCVVVDVSH |
| Ab2 | GTQTYICNVNHKPSNTKVDKRVEPKSCDKTHTCPPCPAPELLGGPSVFLFPPKPKDTLMISRTPEVTCVVVDVSH |
| Ab3 | GTQTYICNVNHKPSNTKVDKRVEPKSCDKTHTCPPCPAPELLGGPSVFLFPPKPKDTLMISRTPEVTCVVVDVSH |
| Ab4 | GTQTYICNVNHKPSNTKVDKRVEPKSCDKTHTCPPCPAPELLGGPSVFLFPPKPKDTLMISRTPEVTCVVVDVSH |
| Ab5 | GTQTYICNVNHKPSNTKVDKRVEPKSCDKTHTCPPCPAPELLGGPSVFLFPPKPKDTLMISRTPEVTCVVVDVSH |
| Ab6 | GTQTYICNVNHKPSNTKVDKRVEPKSCDKTHTCPPCPAPELLGGPSVFLFPPKPKDTLMISRTPEVTCVVVDVSH |
| Ab7 | GTQTYICNVNHKPSNTKVDKRVEPKSCDKTHTCPPCPAPELLGGPSVFLFPPKPKDTLMISRTPEVTCVVVDVSH |
| Ab8 | GTQTYICNVNHKPSNTKVDKRVEPKSCDKTHTCPPCPAPELLGGPSVFLFPPKPKDTLMISRTPEVTCVVVDVSH |
| Ab9 | GTQTYICNVNHKPSNTKVDKRVEPKSCDKTHTCPPCPAPELLGGPSVFLFPPKPKDTLMISRTPEVTCVVVDVSH |
| Ab10 | GTQTYICNVNHKPSNTKVDKRVEPKSCDKTHTCPPCPAPELLGGPSVFLFPPKPKDTLMISRTPEVTCVVVDVSH |
| Ab11 | GTQTYICNVNHKPSNTKVDKRVEPKSCDKTHTCPPCPAPELLGGPSVFLFPPKPKDTLMISRTPEVTCVVVDVSH |
| Ab12 | GTQTYICNVNHKPSNTKVDKRVEPKSCDKTHTCPPCPAPELLGGPSVFLFPPKPKDTLMISRTPEVTCVVVDVSH |
| Ab13 | GTQTYICNVNHKPSNTKVDKRVEPKSCDKTHTCPPCPAPELLGGPSVFLFPPKPKDTLMISRTPEVTCVVVDVSH |
| Ab14 | GTQTYICNVNHKPSNTKVDKRVEPKSCDKTHTCPPCPAPELLGGPSVFLFPPKPKDTLMISRTPEVTCVVVDVSH |
| Ab15 | GTQTYICNVNHKPSNTKVDKRVEPKSCDKTHTCPPCPAPELLGGPSVFLFPPKPKDTLMISRTPEVTCVVVDVSH |
| Ab16 | GTQTYICNVNHKPSNTKVDKRVEPKSCDKTHTCPPCPAPELLGGPSVFLFPPKPKDTLMISRTPEVTCVVVDVSH |
| Ab17 | GTQTYICNVNHKPSNTKVDKRVEPKSCDKTHTCPPCPAPELLGGPSVFLFPPKPKDTLMISRTPEVTCVVVDVSH |
| Ab18 | GTQTYICNVNHKPSNTKVDKRVEPKSCDKTHTCPPCPAPELLGGPSVFLFPPKPKDTLMISRTPEVTCVVVDVSH |
| Ab19 | GTQTYICNVNHKPSNTKVDKRVEPKSCDKTHTCPPCPAPELLGGPSVFLFPPKPKDTLMISRTPEVTCVVVDVSH |
| Ab20 | GTQTYICNVNHKPSNTKVDKRVEPKSCDKTHTCPPCPAPELLGGPSVFLFPPKPKDTLMISRTPEVTCVVVDVSH |
| Ab21 | GTQTYICNVNHKPSNTKVDKRVEPKSCDKTHTCPPCPAPELLGGPSVFLFPPKPKDTLMISRTPEVTCVVVDVSH |
| Ab23 | GTQTYICNVNHKPSNTKVDKRVEPKSCDKTHTCPPCPAPELLGGPSVFLFPPKPKDTLMISRTPEVTCVVVDVSH |
| Ab24 | GTQTYICNVNHKPSNTKVDKRVEPKSCDKTHTCPPCPAPELLGGPSVFLFPPKPKDTLMISRTPEVTCVVVDVSH |
| Ab25 | GTQTYICNVNHKPSNTKVDKRVEPKSCDKTHTCPPCPAPELLGGPSVFLFPPKPKDTLMISRTPEVTCVVVDVSH |
| Ab26 | GTQTYICNVNHKPSNTKVDKRVEPKSCDKTHTCPPCPAPELLGGPSVFLFPPKPKDTLMISRTPEVTCVVVDVSH |
| Ab27 | GTQTYICNVNHKPSNTKVDARVEPKSCDKTHTCPPCPAPELLGGPSVFLFPPKPKDTLMISRTPEVTCVVVDVSH |
| Ab28 | GTQTYICNVNHKPSNTKVDKRVEPKSCDKTHTCPPCPAPELLGGPSVFLFPPKPKDTLMISRTPEVTCVVVDVSH |

Figure 52E
Antibody Heavy chain Protein features

| Sequence Name | Constant region |
|---|---|
| Ab1 | EDPEVKFNWYVDGVEVHNAKTKPREEQYASTYRVVSVLTVLHQDWLNGKEYKCKVSNKALPAPIEKTISKAKGQP |
| Ab2 | EDPEVKFNWYVDGVEVHNAKTKPREEQYASTYRVVSVLTVLHQDWLNGKEYKCKVSNKALPAPIEKTISKAKGQP |
| Ab3 | EDPEVKFNWYVDGVEVHNAKTKPREEQYASTYRVVSVLTVLHQDWLNGKEYKCKVSNKALPAPIEKTISKAKGQP |
| Ab4 | EDPEVKFNWYVDGVEVHNAKTKPREEQYASTYRVVSVLTVLHQDWLNGKEYKCKVSNKALPAPIEKTISKAKGQP |
| Ab5 | EDPEVKFNWYVDGVEVHNAKTKPREEQYASTYRVVSVLTVLHQDWLNGKEYKCKVSNKALPAPIEKTISKAKGQP |
| Ab6 | EDPEVKFNWYVDGVEVHNAKTKPREEQYASTYRVVSVLTVLHQDWLNGKEYKCKVSNKALPAPIEKTISKAKGQP |
| Ab7 | EDPEVKFNWYVDGVEVHNAKTKPREEQYASTYRVVSVLTVLHQDWLNGKEYKCKVSNKALPAPIEKTISKAKGQP |
| Ab8 | EDPEVKFNWYVDGVEVHNAKTKPREEQYASTYRVVSVLTVLHQDWLNGKEYKCKVSNKALPAPIEKTISKAKGQP |
| Ab9 | EDPEVKFNWYVDGVEVHNAKTKPREEQYASTYRVVSVLTVLHQDWLNGKEYKCKVSNKALPAPIEKTISKAKGQP |
| Ab10 | EDPEVKFNWYVDGVEVHNAKTKPREEQYASTYRVVSVLTVLHQDWLNGKEYKCKVSNKALPAPIEKTISKAKGQP |
| Ab11 | EDPEVKFNWYVDGVEVHNAKTKPREEQYASTYRVVSVLTVLHQDWLNGKEYKCKVSNKALPAPIEKTISKAKGQP |
| Ab12 | EDPEVKFNWYVDGVEVHNAKTKPREEQYASTYRVVSVLTVLHQDWLNGKEYKCKVSNKALPAPIEKTISKAKGQP |
| Ab13 | EDPEVKFNWYVDGVEVHNAKTKPREEQYASTYRVVSVLTVLHQDWLNGKEYKCKVSNKALPAPIEKTISKAKGQP |
| Ab14 | EDPEVKFNWYVDGVEVHNAKTKPREEQYASTYRVVSVLTVLHQDWLNGKEYKCKVSNKALPAPIEKTISKAKGQP |
| Ab15 | EDPEVKFNWYVDGVEVHNAKTKPREEQYASTYRVVSVLTVLHQDWLNGKEYKCKVSNKALPAPIEKTISKAKGQP |
| Ab16 | EDPEVKFNWYVDGVEVHNAKTKPREEQYASTYRVVSVLTVLHQDWLNGKEYKCKVSNKALPAPIEKTISKAKGQP |
| Ab17 | EDPEVKFNWYVDGVEVHNAKTKPREEQYASTYRVVSVLTVLHQDWLNGKEYKCKVSNKALPAPIEKTISKAKGQP |
| Ab18 | EDPEVKFNWYVDGVEVHNAKTKPREEQYASTYRVVSVLTVLHQDWLNGKEYKCKVSNKALPAPIEKTISKAKGQP |
| Ab19 | EDPEVKFNWYVDGVEVHNAKTKPREEQYASTYRVVSVLTVLHQDWLNGKEYKCKVSNKALPAPIEKTISKAKGQP |
| Ab20 | EDPEVKFNWYVDGVEVHNAKTKPREEQYASTYRVVSVLTVLHQDWLNGKEYKCKVSNKALPAPIEKTISKAKGQP |
| Ab21 | EDPEVKFNWYVDGVEVHNAKTKPREEQYASTYRVVSVLTVLHQDWLNGKEYKCKVSNKALPAPIEKTISKAKGQP |
| Ab23 | EDPEVKFNWYVDGVEVHNAKTKPREEQYASTYRVVSVLTVLHQDWLNGKEYKCKVSNKALPAPIEKTISKAKGQP |
| Ab24 | EDPEVKFNWYVDGVEVHNAKTKPREEQYASTYRVVSVLTVLHQDWLNGKEYKCKVSNKALPAPIEKTISKAKGQP |
| Ab25 | EDPEVKFNWYVDGVEVHNAKTKPREEQYASTYRVVSVLTVLHQDWLNGKEYKCKVSNKALPAPIEKTISKAKGQP |
| Ab26 | EDPEVKFNWYVDGVEVHNAKTKPREEQYASTYRVVSVLTVLHQDWLNGKEYKCKVSNKALPAPIEKTISKAKGQP |
| Ab27 | EDPEVKFNWYVDGVEVHNAKTKPREEQYASTYRVVSVLTVLHQDWLNGKEYKCKVSNKALPAPIEKTISKAKGQP |
| Ab28 | EDPEVKFNWYVDGVEVHNAKTKPREEQYASTYRVVSVLTVLHQDWLNGKEYKCKVSNKALPAPIEKTISKAKGQP |

Figure 52F
Antibody Heavy chain Protein features

| Sequence Name | Constant region |
|---|---|
| Ab1 | REPQVYTLPPSREEMTKNQVSLTCLVKGFYPSDIAVEWESNGQPENNYKTTPPVLDSDGSFFLYSKLTVDKSRWQ |
| Ab2 | REPQVYTLPPSREEMTKNQVSLTCLVKGFYPSDIAVEWESNGQPENNYKTTPPVLDSDGSFFLYSKLTVDKSRWQ |
| Ab3 | REPQVYTLPPSREEMTKNQVSLTCLVKGFYPSDIAVEWESNGQPENNYKTTPPVLDSDGSFFLYSKLTVDKSRWQ |
| Ab4 | REPQVYTLPPSREEMTKNQVSLTCLVKGFYPSDIAVEWESNGQPENNYKTTPPVLDSDGSFFLYSKLTVDKSRWQ |
| Ab5 | REPQVYTLPPSREEMTKNQVSLTCLVKGFYPSDIAVEWESNGQPENNYKTTPPVLDSDGSFFLYSKLTVDKSRWQ |
| Ab6 | REPQVYTLPPSREEMTKNQVSLTCLVKGFYPSDIAVEWESNGQPENNYKTTPPVLDSDGSFFLYSKLTVDKSRWQ |
| Ab7 | REPQVYTLPPSREEMTKNQVSLTCLVKGFYPSDIAVEWESNGQPENNYKTTPPVLDSDGSFFLYSKLTVDKSRWQ |
| Ab8 | REPQVYTLPPSREEMTKNQVSLTCLVKGFYPSDIAVEWESNGQPENNYKTTPPVLDSDGSFFLYSKLTVDKSRWQ |
| Ab9 | REPQVYTLPPSREEMTKNQVSLTCLVKGFYPSDIAVEWESNGQPENNYKTTPPVLDSDGSFFLYSKLTVDKSRWQ |
| Ab10 | REPQVYTLPPSREEMTKNQVSLTCLVKGFYPSDIAVEWESNGQPENNYKTTPPVLDSDGSFFLYSKLTVDKSRWQ |
| Ab11 | REPQVYTLPPSREEMTKNQVSLTCLVKGFYPSDIAVEWESNGQPENNYKTTPPVLDSDGSFFLYSKLTVDKSRWQ |
| Ab12 | REPQVYTLPPSREEMTKNQVSLTCLVKGFYPSDIAVEWESNGQPENNYKTTPPVLDSDGSFFLYSKLTVDKSRWQ |
| Ab13 | REPQVYTLPPSREEMTKNQVSLTCLVKGFYPSDIAVEWESNGQPENNYKTTPPVLDSDGSFFLYSKLTVDKSRWQ |
| Ab14 | REPQVYTLPPSREEMTKNQVSLTCLVKGFYPSDIAVEWESNGQPENNYKTTPPVLDSDGSFFLYSKLTVDKSRWQ |
| Ab15 | REPQVYTLPPSREEMTKNQVSLTCLVKGFYPSDIAVEWESNGQPENNYKTTPPVLDSDGSFFLYSKLTVDKSRWQ |
| Ab16 | REPQVYTLPPSREEMTKNQVSLTCLVKGFYPSDIAVEWESNGQPENNYKTTPPVLDSDGSFFLYSKLTVDKSRWQ |
| Ab17 | REPQVYTLPPSREEMTKNQVSLTCLVKGFYPSDIAVEWESNGQPENNYKTTPPVLDSDGSFFLYSKLTVDKSRWQ |
| Ab18 | REPQVYTLPPSREEMTKNQVSLTCLVKGFYPSDIAVEWESNGQPENNYKTTPPVLDSDGSFFLYSKLTVDKSRWQ |
| Ab19 | REPQVYTLPPSREEMTKNQVSLTCLVKGFYPSDIAVEWESNGQPENNYKTTPPVLDSDGSFFLYSKLTVDKSRWQ |
| Ab20 | REPQVYTLPPSREEMTKNQVSLTCLVKGFYPSDIAVEWESNGQPENNYKTTPPVLDSDGSFFLYSKLTVDKSRWQ |
| Ab21 | REPQVYTLPPSREEMTKNQVSLTCLVKGFYPSDIAVEWESNGQPENNYKTTPPVLDSDGSFFLYSKLTVDKSRWQ |
| Ab23 | REPQVYTLPPSREEMTKNQVSLTCLVKGFYPSDIAVEWESNGQPENNYKTTPPVLDSDGSFFLYSKLTVDKSRWQ |
| Ab24 | REPQVYTLPPSREEMTKNQVSLTCLVKGFYPSDIAVEWESNGQPENNYKTTPPVLDSDGSFFLYSKLTVDKSRWQ |
| Ab25 | REPQVYTLPPSREEMTKNQVSLTCLVKGFYPSDIAVEWESNGQPENNYKTTPPVLDSDGSFFLYSKLTVDKSRWQ |
| Ab26 | REPQVYTLPPSREEMTKNQVSLTCLVKGFYPSDIAVEWESNGQPENNYKTTPPVLDSDGSFFLYSKLTVDKSRWQ |
| Ab27 | REPQVYTLPPSREEMTKNQVSLTCLVKGFYPSDIAVEWESNGQPENNYKTTPPVLDSDGSFFLYSKLTVDKSRWQ |
| Ab28 | REPQVYTLPPSREEMTKNQVSLTCLVKGFYPSDIAVEWESNGQPENNYKTTPPVLDSDGSFFLYSKLTVDKSRWQ |

Figure 52G
Antibody Heavy chain Protein features

| Sequence Name | Constant region | |
|---|---|---|
| Ab1 | QGNVFSCSVMHEALHNHYTQKSLSLSPGK | (SEQ_ID_NO:1) |
| Ab2 | QGNVFSCSVMHEALHNHYTQKSLSLSPGK | (SEQ_ID_NO:41) |
| Ab3 | QGNVFSCSVMHEALHNHYTQKSLSLSPGK | (SEQ_ID_NO:81) |
| Ab4 | QGNVFSCSVMHEALHNHYTQKSLSLSPGK | (SEQ_ID_NO:121) |
| Ab5 | QGNVFSCSVMHEALHNHYTQKSLSLSPGK | (SEQ_ID_NO:161) |
| Ab6 | QGNVFSCSVMHEALHNHYTQKSLSLSPGK | (SEQ_ID_NO:201) |
| Ab7 | QGNVFSCSVMHEALHNHYTQKSLSLSPGK | (SEQ_ID_NO:241) |
| Ab8 | QGNVFSCSVMHEALHNHYTQKSLSLSPGK | (SEQ_ID_NO:281) |
| Ab9 | QGNVFSCSVMHEALHNHYTQKSLSLSPGK | (SEQ_ID_NO:321) |
| Ab10 | QGNVFSCSVMHEALHNHYTQKSLSLSPGK | (SEQ_ID_NO:361) |
| Ab11 | QGNVFSCSVMHEALHNHYTQKSLSLSPGK | (SEQ_ID_NO:401) |
| Ab12 | QGNVFSCSVMHEALHNHYTQKSLSLSPGK | (SEQ_ID_NO:441) |
| Ab13 | QGNVFSCSVMHEALHNHYTQKSLSLSPGK | (SEQ_ID_NO:481) |
| Ab14 | QGNVFSCSVMHEALHNHYTQKSLSLSPGK | (SEQ_ID_NO:521) |
| Ab15 | QGNVFSCSVMHEALHNHYTQKSLSLSPGK | (SEQ_ID_NO:561) |
| Ab16 | QGNVFSCSVMHEALHNHYTQKSLSLSPGK | (SEQ_ID_NO:601) |
| Ab17 | QGNVFSCSVMHEALHNHYTQKSLSLSPGK | (SEQ_ID_NO:641) |
| Ab18 | QGNVFSCSVMHEALHNHYTQKSLSLSPGK | (SEQ_ID_NO:681) |
| Ab19 | QGNVFSCSVMHEALHNHYTQKSLSLSPGK | (SEQ_ID_NO:721) |
| Ab20 | QGNVFSCSVMHEALHNHYTQKSLSLSPGK | (SEQ_ID_NO:761) |
| Ab21 | QGNVFSCSVMHEALHNHYTQKSLSLSPGK | (SEQ_ID_NO:801) |
| Ab23 | QGNVFSCSVMHEALHNHYTQKSLSLSPGK | (SEQ_ID_NO:841) |
| Ab24 | QGNVFSCSVMHEALHNHYTQKSLSLSPGK | (SEQ_ID_NO:881) |
| Ab25 | QGNVFSCSVMHEALHNHYTQKSLSLSPGK | (SEQ_ID_NO:921) |
| Ab26 | QGNVFSCSVMHEALHNHYTQKSLSLSPGK | (SEQ_ID_NO:961) |
| Ab27 | QGNVFSCSVMHEALHNHYTQKSLSLSPGK | (SEQ_ID_NO:1001) |
| Ab28 | QGNVFSCSVMHEALHNHYTQKSLSLSPGK | (SEQ_ID_NO:1041) |

Figure 53A
Antibody Light chain Protein features

| Sequence Name | FR1 | CDR1 | FR2 | CDR2 |
|---|---|---|---|---|
| Ab1  | AYDMTQTPASVEVAVGGTVTIKC | QASQSISSWLA     | WYQQKPGQPPKLLIY | QASKLAS |
| Ab2  | DIQMTQSPSTLSASVGDRVTITC | QASQSISSWLA     | WYQQKPGKAPKLLIY | QASKLAS |
| Ab3  | AYDMTQTPASVEIAVGGTVTIRC | QASEDIESYLA     | WYQQKPGQPPKLLIY | RASDLAS |
| Ab4  | AYDMTQSPASVEAAVGGTVTIRC | QASEDIESYLA     | WYQQKPGQPPKLLIY | RASDLAS |
| Ab5  | AYDMTQTPASMEVAVGGTVTIKC | QASQSISTYLA     | WYQQKPGQPPKLLIY | DASDIAS |
| Ab6  | ADIVMTQTPSSVEAAVGGTVTIKC| QASENIYRLLA     | WYQQKPGQRPKLLIY | SASTLAS |
| Ab7  | AYDMTQTPASVEVAVGGTVTIKC | QASQSISSWLA     | WYQQKPGQPPKLLIY | EASKLAS |
| Ab8  | DIQMTQSPSTLSASVGDRVTITC | QASQSISSWLA     | WYQQKPGKAPKLLIY | EASKLAS |
| Ab9  | QVLTQTPPSVSAVVGGTVTINC  | QSSQRIYSNWLS    | WYQQKPGQTPKPLIY | AASSLAS |
| Ab10 | DIQMTQSPSSVSASVGDRVTITC | QSSQRIYSNWLS    | WYQQKPGKAPKLLIY | AASSLAS |
| Ab11 | AVLTQTPSPVSAAVGGTVTIKC  | QSSQSVYNNNLLS   | WYQKKPGQPPKLLIW | GASYLPS |
| Ab12 | AYDMTQTPASVEVAVGGTVTIKC | QVSQSISSWLS     | WYQKKPGQRPKLLIY | RASTLAS |
| Ab13 | DYQMTQSPSTLSASVGDRVTITC | QVSQSISSWLS     | WYQQKPGKAPKLLIY | RASTLAS |
| Ab14 | AYDMTQTPASVEVAVGGTVTIKC | QASESIESYLA     | WYQQKSGQPPKLLIY | RASTLAS |
| Ab15 | AYDMTQTPASVEVAVGGTVTIKC | QASESISSYLA     | WYQQKSGQPPKLLIY | RASTLAS |
| Ab16 | QVLTQTPSPVSAAVGGTVTINC  | QGSQSLYNNNAFS   | WYQQKPGQPPKLLIY | DASTLAS |
| Ab17 | QVLTQTPSPVSAAVGGTVTINC  | QASQSFYNNGAFS   | WYQQKPGQPPKLLIY | DASTLAS |
| Ab18 | AYDMTQTPASVEVAVGGTVTIKC | QASQSISTALA     | WYQQKPGQRPKLLIY | DASKLAS |
| Ab19 | DVVMTQTPASVSEPVGGTVTIKC | QASQSIDNYLA     | WYQQKPGQRPRLLIY | YTSTLAS |
| Ab20 | DIQMTQSPSSLSASVGDRVTITC | QASQSIDNYLA     | WYQQKPGKVPKLLIY | YTSTLAS |
| Ab21 | AYDMTQTPASVEVAVGGTVTIKC | QASESISSYLN     | WYQQKLGQPPKLLIY | RASTLTS |
| Ab23 | AYDMTQTPASVEVAVGGTVTIKC | QASESISTYLA     | WYQQKPGQPPKLLIY | RASTLAS |
| Ab24 | DIQMTQSPSSLSASVGDRVTITC | QASESISTYLA     | WYQQKPGKVPKLLIY | RASTLAS |
| Ab25 | QVLTQTASSVSAAVGGTVTISC  | QSSQSVTNNNDLA   | WYQQKPGQPPKLLIY | QASKLAS |
| Ab26 | ADVVMTQTPASVSEPVGGTVTIKC| QASQSISSYLS     | WYQQKPGQPPKLLIY | GASKLTS |
| Ab27 | ADIVMTQNPASVSEPVGGTVTIKC| QASQSVNSWLS     | WYQQKPGQPPKFLIY | KASTLAS |
| Ab28 | DIQMTQSPSTLSASVGDRVTITC | QASQSISSWLA     | WYQQKPGKAPKLLIY | EASKLAS |

Figure 53B
Antibody Light chain Protein features

| Sequence Name | FR3 | CDR3 | FR4 |
|---|---|---|---|
| Ab1 | GVPSRFKGSGSGTEFTLTISGVECADAATYYC | QQAYSVSNVDNA | FGGGTEVVVKR |
| Ab2 | GVPSRFSGSGSGTEFTLTISSLQPDDFATYYC | QQAYSVSNVDNA | FGGGTKVEIKR |
| Ab3 | GVSSRFKGSGSGTDYLTISGVECDDAATYYC | QQGYTIDNVDNT | FGGGTEVVVKR |
| Ab4 | GVSSRFKGSGSGTDYLTISGLEPEDAATYYC | QQGYTIDNVDNT | FGGGTKVEIKR |
| Ab5 | GVSSRFKGSGSGTQFTLTISGVECDDAATYYC | QQDWSDSNVDNA | FGGGTEVVVKR |
| Ab6 | GVPSRFKGSGSGTQFTLTISDLECADAATYYC | QNYYYSSRSSYDTYNV | FGGGTEVVVKR |
| Ab7 | GVPSRFSGSGSGTQFTLTISGVECADAATYYC | QQAYSVANVDNA | FGGGTEVVVKR |
| Ab8 | GVSSRFSGSGSGTEFTLTISSLQPDDFATYYC | QQAYSVANVDNA | FGGGTKVEIKR |
| Ab9 | GVPSRFKGSGSGTQFTLTISDLECDDAASYYC | AGYYSGHIYS | FGGGTEVVVKR |
| Ab10 | GVPSRFSGSGSGTDFTLTISSLQPEDFATYYC | AGYYSGHIYS | FGGGTKVEIKR |
| Ab11 | GVPDRFSGSGSGTQFTLTISGVQCDDAATYYC | LGGYDGDADTYNT | FGGGTEVVVKR |
| Ab12 | GVSSRFKGSGSGTEFTLTISGVECADAATYYC | QQAYSVSNVDNA | FGGGTKVEIKR |
| Ab13 | GVPSRFSGSGSGTEFTLTISSLQPDDFATYYC | QQAYSVSNVDNA | FGGGTEVVVKR |
| Ab14 | GVSSRFKGSGSGTQFTLTISGVECADAATYYC | QQGDAWSNVDNV | FGGGTEVVVKR |
| Ab15 | GVSSRFKGSGSGTQFTLTISGVECADAATYYC | QQGDAWSNVDNV | FGGGTEVVVKR |
| Ab16 | GVPSRFKGSGSGTQFTLTISGVQCADAATYYC | QGEFSCGDVDCIA | FGGGTEVVVKR |
| Ab17 | GVPSRFKGSGSGTQFTLTISGVQCGDAATYYC | QGEFSCGSADCVA | FGGGTEVVVKR |
| Ab18 | GVSSRFKGSGSGAQFTLTISGVECADAATYYC | HQGYSSSNVDNT | FGGGTEVVVKR |
| Ab19 | GVPSRFKGSGSGTEYTLTISDLECADAATYYC | QFTAYYSTYIGA | FGGGTKVEIKR |
| Ab20 | GVPSRFSGSGSGTDFTLTISSLQPEDVATYYC | QFTAYYSTYIGA | FGGGTEVVVKR |
| Ab21 | GVSSRFKGSGSGTEYTLTISDLECADAATYYC | QQTYGYSDTDNS | FGGGTEVVVKR |
| Ab23 | GVSSRFKGSGSGTDFTLTISGVECADAATYYC | QQGYSYSNVDNA | FGGGTKVEIKR |
| Ab24 | GVPSRFKGSGSGTDFTLTISLQPEDVATYYC | QQGYSYSNVDNA | FGGGTEVVVKR |
| Ab25 | GVPSRFKGSGSGTQFTLTISDLECDDAATYYC | QGSYSGGICA | FGGGTEVVVKR |
| Ab26 | GVPSRFKGSGSGTEYTLTISDLECADAATYYC | QSNYDIYSYA | FGGGTKVEIKR |
| Ab27 | GVSSRFKGSGIGTEFTLTISDLECADAATYYC | QFSNSGTIYGSG | FGGGTEVVVKR |
| Ab28 | GVPSRFSGSGSGTEFTLTISSLQPDDFATYYC | QQAYSVANVDNA | FGGGTKVEIKR |

Figure 53C
Antibody Light chain Protein features

| Sequence Name | Constant region |
|---|---|
| Ab1 | TVAAPSVFIFPPSDEQLKSGTASVVCLLNNFYPREAKVQWKVDNALQSGNSQESVTEQDSKDSTYSLSSTLTLSKA |
| Ab2 | TVAAPSVFIFPPSDEQLKSGTASVVCLLNNFYPREAKVQWKVDNALQSGNSQESVTEQDSKDSTYSLSSTLTLSKA |
| Ab3 | TVAAPSVFIFPPSDEQLKSGTASVVCLLNNFYPREAKVQWKVDNALQSGNSQESVTEQDSKDSTYSLSSTLTLSKA |
| Ab4 | TVAAPSVFIFPPSDEQLKSGTASVVCLLNNFYPREAKVQWKVDNALQSGNSQESVTEQDSKDSTYSLSSTLTLSKA |
| Ab5 | TVAAPSVFIFPPSDEQLKSGTASVVCLLNNFYPREAKVQWKVDNALQSGNSQESVTEQDSKDSTYSLSSTLTLSKA |
| Ab6 | TVAAPSVFIFPPSDEQLKSGTASVVCLLNNFYPREAKVQWKVDNALQSGNSQESVTEQDSKDSTYSLSSTLTLSKA |
| Ab7 | TVAAPSVFIFPPSDEQLKSGTASVVCLLNNFYPREAKVQWKVDNALQSGNSQESVTEQDSKDSTYSLSSTLTLSKA |
| Ab8 | TVAAPSVFIFPPSDEQLKSGTASVVCLLNNFYPREAKVQWKVDNALQSGNSQESVTEQDSKDSTYSLSSTLTLSKA |
| Ab9 | TVAAPSVFIFPPSDEQLKSGTASVVCLLNNFYPREAKVQWKVDNALQSGNSQESVTEQDSKDSTYSLSSTLTLSKA |
| Ab10 | TVAAPSVFIFPPSDEQLKSGTASVVCLLNNFYPREAKVQWKVDNALQSGNSQESVTEQDSKDSTYSLSSTLTLSKA |
| Ab11 | TVAAPSVFIFPPSDEQLKSGTASVVCLLNNFYPREAKVQWKVDNALQSGNSQESVTEQDSKDSTYSLSSTLTLSKA |
| Ab12 | TVAAPSVFIFPPSDEQLKSGTASVVCLLNNFYPREAKVQWKVDNALQSGNSQESVTEQDSKDSTYSLSSTLTLSKA |
| Ab13 | TVAAPSVFIFPPSDEQLKSGTASVVCLLNNFYPREAKVQWKVDNALQSGNSQESVTEQDSKDSTYSLSSTLTLSKA |
| Ab14 | TVAAPSVFIFPPSDEQLKSGTASVVCLLNNFYPREAKVQWKVDNALQSGNSQESVTEQDSKDSTYSLSSTLTLSKA |
| Ab15 | TVAAPSVFIFPPSDEQLKSGTASVVCLLNNFYPREAKVQWKVDNALQSGNSQESVTEQDSKDSTYSLSSTLTLSKA |
| Ab16 | TVAAPSVFIFPPSDEQLKSGTASVVCLLNNFYPREAKVQWKVDNALQSGNSQESVTEQDSKDSTYSLSSTLTLSKA |
| Ab17 | TVAAPSVFIFPPSDEQLKSGTASVVCLLNNFYPREAKVQWKVDNALQSGNSQESVTEQDSKDSTYSLSSTLTLSKA |
| Ab18 | TVAAPSVFIFPPSDEQLKSGTASVVCLLNNFYPREAKVQWKVDNALQSGNSQESVTEQDSKDSTYSLSSTLTLSKA |
| Ab19 | TVAAPSVFIFPPSDEQLKSGTASVVCLLNNFYPREAKVQWKVDNALQSGNSQESVTEQDSKDSTYSLSSTLTLSKA |
| Ab20 | TVAAPSVFIFPPSDEQLKSGTASVVCLLNNFYPREAKVQWKVDNALQSGNSQESVTEQDSKDSTYSLSSTLTLSKA |
| Ab21 | TVAAPSVFIFPPSDEQLKSGTASVVCLLNNFYPREAKVQWKVDNALQSGNSQESVTEQDSKDSTYSLSSTLTLSKA |
| Ab23 | TVAAPSVFIFPPSDEQLKSGTASVVCLLNNFYPREAKVQWKVDNALQSGNSQESVTEQDSKDSTYSLSSTLTLSKA |
| Ab24 | TVAAPSVFIFPPSDEQLKSGTASVVCLLNNFYPREAKVQWKVDNALQSGNSQESVTEQDSKDSTYSLSSTLTLSKA |
| Ab25 | TVAAPSVFIFPPSDEQLKSGTASVVCLLNNFYPREAKVQWKVDNALQSGNSQESVTEQDSKDSTYSLSSTLTLSKA |
| Ab26 | TVAAPSVFIFPPSDEQLKSGTASVVCLLNNFYPREAKVQWKVDNALQSGNSQESVTEQDSKDSTYSLSSTLTLSKA |
| Ab27 | TVAAPSVFIFPPSDEQLKSGTASVVCLLNNFYPREAKVQWKVDNALQSGNSQESVTEQDSKDSTYSLSSTLTLSKA |
| Ab28 | TVAAPSVFIFPPSDEQLKSGTASVVCLLNNFYPREAKVQWKVDNALQSGNSQESVTEQDSKDSTYSLSSTLTLSKA |

Figure 53D
Antibody Light chain Protein features

| Sequence Name | Constant region | |
|---|---|---|
| Ab1 | DYEKHKVYACEVTHQGLSSPVTKSFNRGEC | (SEQ ID NO:21) |
| Ab2 | DYEKHKVYACEVTHQGLSSPVTKSFNRGEC | (SEQ ID NO:61) |
| Ab3 | DYEKHKVYACEVTHQGLSSPVTKSFNRGEC | (SEQ ID NO:101) |
| Ab4 | DYEKHKVYACEVTHQGLSSPVTKSFNRGEC | (SEQ ID NO:141) |
| Ab5 | DYEKHKVYACEVTHQGLSSPVTKSFNRGEC | (SEQ ID NO:181) |
| Ab6 | DYEKHKVYACEVTHQGLSSPVTKSFNRGEC | (SEQ ID NO:221) |
| Ab7 | DYEKHKVYACEVTHQGLSSPVTKSFNRGEC | (SEQ ID NO:261) |
| Ab8 | DYEKHKVYACEVTHQGLSSPVTKSFNRGEC | (SEQ ID NO:301) |
| Ab9 | DYEKHKVYACEVTHQGLSSPVTKSFNRGEC | (SEQ ID NO:341) |
| Ab10 | DYEKHKVYACEVTHQGLSSPVTKSFNRGEC | (SEQ ID NO:381) |
| Ab11 | DYEKHKVYACEVTHQGLSSPVTKSFNRGEC | (SEQ ID NO:421) |
| Ab12 | DYEKHKVYACEVTHQGLSSPVTKSFNRGEC | (SEQ ID NO:461) |
| Ab13 | DYEKHKVYACEVTHQGLSSPVTKSFNRGEC | (SEQ ID NO:501) |
| Ab14 | DYEKHKVYACEVTHQGLSSPVTKSFNRGEC | (SEQ ID NO:541) |
| Ab15 | DYEKHKVYACEVTHQGLSSPVTKSFNRGEC | (SEQ ID NO:581) |
| Ab16 | DYEKHKVYACEVTHQGLSSPVTKSFNRGEC | (SEQ ID NO:621) |
| Ab17 | DYEKHKVYACEVTHQGLSSPVTKSFNRGEC | (SEQ ID NO:661) |
| Ab18 | DYEKHKVYACEVTHQGLSSPVTKSFNRGEC | (SEQ ID NO:701) |
| Ab19 | DYEKHKVYACEVTHQGLSSPVTKSFNRGEC | (SEQ ID NO:741) |
| Ab20 | DYEKHKVYACEVTHQGLSSPVTKSFNRGEC | (SEQ ID NO:781) |
| Ab21 | DYEKHKVYACEVTHQGLSSPVTKSFNRGEC | (SEQ ID NO:821) |
| Ab23 | DYEKHKVYACEVTHQGLSSPVTKSFNRGEC | (SEQ ID NO:861) |
| Ab24 | DYEKHKVYACEVTHQGLSSPVTKSFNRGEC | (SEQ ID NO:901) |
| Ab25 | DYEKHKVYACEVTHQGLSSPVTKSFNRGEC | (SEQ ID NO:941) |
| Ab26 | DYEKHKVYACEVTHQGLSSPVTKSFNRGEC | (SEQ ID NO:981) |
| Ab27 | DYEKHKVYACEVTHQGLSSPVTKSFNRGEC | (SEQ ID NO:1021) |
| Ab28 | DYEKHKVYACEVTHQGLSSPVTKSFNRGEC | (SEQ ID NO:1061) |

Figure 54A
Antibody Heavy chain DNA features

| Sequence Name | FR1 |
|---|---|
| Ab1 | cagtcggtggaggagtccggggtcgcctggtcacgcctggtcacgcctggggtcgggggtcgcctggacactcacctgcacagtctctggat |
| Ab2 | gaggtgcagctggtggagtctgggggaggcttgtccagcctggggggtccctgagactctcctgtgcagcctctg |
| Ab3 | cagtcggtggaggagtctggggtctggggggtcgcctggtcacgcctggtccagcctggggacactcacctgcacagtctctggac |
| Ab4 | cagtcgctggaggagtctggggacctggggggtcgcctggtcacgcctggtccagcctggggacactcacctcctgtacagcctctggac |
| Ab5 | cagtcgctggaggagtctggggggtccggggggtcgcctggtcacgcctggtccagcctggggacactcacctgcacagtctctggac |
| Ab6 | cagtcggtggaggagtccggggtcgggggtcgcctggtcatgcctggtccagcctggggacactcacctgcaccgtctctggat |
| Ab7 | cagtcggtggaggagtccgggggtccggggggtcgcctggtcatgcctggtccagcctggggacactcacctgcaccgtctctggat |
| Ab8 | gaggtgcagctggtggagtctgggggaggcttggtccagcctggggacactcacctgtgcacagtctctggaa |
| Ab9 | cagtcggtggaggagtccgggggtccggggggtcgcctggtcacgcctggtccagcctgggacactcacctgtgcacagtctctggat |
| Ab10 | gaggtgcagctggtggagtctgggggaggcttggtccagcctggggacactcacctgtgcacagtctctggat |
| Ab11 | cagtcaatggaggagtccgggggtccggggggtcgcctggtcacgcctggtccagcctggggacactcacctgcacagtctctggat |
| Ab12 | cagtcgctggaggagtccgggggtccggggggtcgcctggtcgtaacgcctggtccagcctggggacactcacctgcacagtctctggaa |
| Ab13 | gaggtgcagctggtggagtctggggggtccgggggggtcgcctggtcacgcctggtccagcctgggacactcacctgtgcacagtctctggat |
| Ab14 | cagtcggtggaggagtccgggggtccggggggtcgcctggtcacgcctggtccagcctggggacactcacctgcacagtctctggat |
| Ab15 | cagtcggtggaggagtccgggggtccggggggtcgcctggtcgcgcctggtccagcctgggacactcacctgcacagtctctggat |
| Ab16 | cagtcggtggaggagtccgggggtccggggggtcgcctggtcacgcctggtccagcctggggacactcacctgcacagtctctggaa |
| Ab17 | cagtcggtggaggagtccgggggtccggggggtcgcctggtcacgcctggtccagcctggggacactcacctgcacagtctctggaa |
| Ab18 | cagtcggtggaggagtccgggggtccggggggtcgcctggtcacgcctggtccagcctggggacactcacctgcacagtctctggat |
| Ab19 | cagtcggtggaggagtccgggggtccggggggtcgcctggtcacgcctggtccagcctggggacactcacctgcacagtctctggat |
| Ab20 | gaggtgcagctggtggagtctgggggaggcttggtccagcctggggacactcacctgtgcacgtctctggat |
| Ab21 | cagtcggtggaggagtccgggggtccgggggggtcgcctggtcacgcctggtccagcctgggacactcacctgtgcacagtctctggat |
| Ab23 | cagtcgctggaggagtccgggggtccggggggtcgcctggtcacgcctggtccagcctggggacactcacctgcacagcctctggat |
| Ab24 | gaggtgcagctggtggagtctggggggtccgggggggtcgcctggtcacgcctggtccagcctgggacactcacctgtgcacagcctctg |
| Ab25 | cagtcgctggaggagtccgggggtccgggggggtcgcctggtcacgcctggtccagcctggggacactcacctgcacagcctctggat |
| Ab26 | cagtcggtggaggagtccgggggtccggggggtcgcctggtcacgcctggtccaagcctggggacactcacctgcacagcctctggat |
| Ab27 | cagtcgttggaggagtctgggggagacctggtccaagcctggggaggaacctcacctgcacagcctctggat |
| Ab28 | gaggtgcagctggtggagtctggggggaggcttggtccagcctggggggtccctgagactctcctgtgcagcctctg |

Figure 54B
Antibody Heavy chain DNA features

| Sequence Name | FR1 | CDR1 | FR2 |
|---|---|---|---|
| Ab1 | tctccctcagt | gcctatgcaatgagc | tgggtccgccaggctccagagagaagggctggagtggatcgca |
| Ab2 | gattcaccgtcagt | gcctatgcaatgagc | tgggtccgtcaggctccaggaggaagggctggagtggtcgca |
| Ab3 | tcaccattagt | agctactacatgagc | tgggtccgccaggctccagggaaggggctggaatggatcgga |
| Ab4 | tcaccattagt | agctactacatgagc | tgggtccgtcaggctccagggaaggggctggagtgggtcgga |
| Ab5 | tctccctcaat | aattatgcagtgggc | tgggtccgccaggctccagggaaggggctggaatggatcgga |
| Ab6 | tctccctcagt | agcaatgcaataagc | tgggtccgccaggctccagagagaagggctggagtggatcgga |
| Ab7 | tctccctcagt | agcaatgcaataagc | tgggtccgtcaggctccagagagaagggctggaatggatcgga |
| Ab8 | gattcaccgtcagt | agcaatgcaataagc | tgggtccgtcaggctccagggaaggggctggagtgggtcgga |
| Ab9 | tcgacctcaat | agcaatggaatgagc | tgggtccgccaggctccagggaggggctggaatggatcgga |
| Ab10 | gattcaccgtcagt | agcaatggaatgagc | tgggtccgccaggctccagggaaggggctggagtgggtcgga |
| Ab11 | tctccctcagt | gactatgcgttgagc | tgggtccgccaggctccagagagaagggctggagtggatcgca |
| Ab12 | tcgacctcagt | agcaatgcaataagc | tgggtccgtcaggctccagggaaggggctggaatggatcgga |
| Ab13 | gattcaccgtcagt | agcaatgcaataagc | tgggtccgccaggctccagagagaagggctggagtgggtcgca |
| Ab14 | tctccctcagt | aactacgcaatgacc | tgggtccgccaggctccagggaaggggctggaatggatcgga |
| Ab15 | tctccctcagt | aactacgcaatgacc | tgggtccgtcaggctccagggaaggggctggaatggatcgga |
| Ab16 | tcgacctcagt | aattatgcaatgagc | tgggtccgccaggctccagggaaggggctggaatacatcgga |
| Ab17 | tcgacctcagt | agctatgcaatgggc | tgggtccgccaggctccagggaaggggctggaatggatcgga |
| Ab18 | tctccctcagc | agctacgacatgagc | tgggtccgccaggctccagggaaggggctggagtggatcgga |
| Ab19 | tctccctcagt | aattattggatgggc | tgggtccgccaggctccagggaggggctggagtggatcgga |
| Ab20 | gattcaccgtcagt | aactattggatgggc | tgggtccgtcaggctccagggaaggggctggagtggatcgga |
| Ab21 | tctccctcagt | acctactacatgagc | tgggtccgccaggctccagggaaggggctggaatggatcgga |
| Ab23 | tcactatcggt | cgctactacatgagc | tgggtccgccaggctccagggaaggggctggaatggatcgga |
| Ab24 | gattcaccgtcggt | cgctactacatgagc | tgttccgccaggctccagggaaggggctggagtggatcgga |
| Ab25 | tctccctcagt | agctatgcaatgggc | tgggtccgccaggctccagggaaggggctggagtggatcgca |
| Ab26 | tctccctcagt | acctatacaatgaac | tgggtccgccaggctccagggaaggggctggaatacatcgga |
| Ab27 | tctccttcagt | gacgaccactacatgtgc | tgggtccgccaggctccagggaaggggctggcagtggatcgca |
| Ab28 | gattcaccgtcagt | agcaatgcaataagc | tgggtccgtcaggctccagggaaggggctggagtgggtcgga |

Figure 54C
Antibody Heavy chain DNA features

| Sequence Name | CDR2 | FR3 |
|---|---|---|
| Ab1 | gtcatttatgttattggtgccactgactacgcgagctgggcgaaaggc | cgattcaccatctccagaacct |
| Ab2 | gtcatctatgttattggtgccactgactacgcgagcagtgcgaaaggc | cgattcaccatctccagagaca |
| Ab3 | accattaatcctggtgctaacatacttcgcgagctgggcaaaaggc | cgattcaccatctccagaacct |
| Ab4 | accatcaatcctggtgctaacacatactcgcgagctctgcaaaaggc | cgattcaccatctccagatcct |
| Ab5 | atcatttacctagtggtaacacagactacgcgaactgggcgaaaggc | cgattcaccatctccaaaacct |
| Ab6 | gtcatttatgttattggtgtcactgactacgcgagctgggcgcaaggc | cgattcaccatctccaaaacct |
| Ab7 | gtcatttatgttattggtgtcactgactacgcgagctgggcgcaaggc | cgattcaccatctccaaaacct |
| Ab8 | gtcatttatgttattggtgtcactgactacgcgagctctgcgcaaggc | cgattcaccatctccagagaca |
| Ab9 | gccagtagtattgatgggaccacatactacacacaattgggcgaaggc | cgattcaccatctccaaaacct |
| Ab10 | gccagtagtattgatgggaccacatactacacacaattctgcgaaggc | cgattcaccatctccagagaca |
| Ab11 | atgattagtagtgtgacaacatactacgcgagctgggcgaaaggc | cgattcaccatctccaaagcct |
| Ab12 | gtcatttatgtgttgtggtgccactgactacgcgagctgggcgaaaggc | cgattcaccatctccagaacct |
| Ab13 | gtcatctatgttgtgtgtgccactgactacatactacgcgagcagtgcgaaaggc | cgattcaccatctccagagaca |
| Ab14 | gtcattagtttgtgtggtggtaacacatactacgcgaactgggcgaaaggc | cgattcaccatctccaaaacct |
| Ab15 | gtcattagtttgtgtggtggtaacacatactacgcgaactgggcgaaaggc | cgattcaccatctccaaaacct |
| Ab16 | atgattggtgttaatggtagggcatgtacgcggactgggcgaaaggc | cgattcaccatctccagacct |
| Ab17 | atgattgatgttagtgctagcacgctactacgcggactgggcgaaaggc | cgactcaccatctccaaaacct |
| Ab18 | atcatttatgctgtgtagtgctagcacatgtcacacatggttcgcgagctgcgagctgggtgaaaggc | cgattcaccatctccaaaacct |
| Ab19 | accattagttatgatggtaacacatactacgcgagctgggcaaaaggc | cgcttcaccatctccgaacct |
| Ab20 | accattagttatgatggtaacacatactacgcgagcagcgcaaaaggc | cgattcaccatctccagagaca |
| Ab21 | atcatttatgttagtggtatcacggactacgcgaggtgggcgaaaggc | cgattcaccatctccaaaacct |
| Ab23 | atcatctatactcatgtgttaaccagactactacccagactacgcgagctgggcgaaaggc | cgattcaccatctccagaccct |
| Ab24 | atcatctatactcatgtgttaaccagactacgcgagctacgcgagcagcgcgaaaggc | cgattcaccatctccagagaca |
| Ab25 | tacattttgctagtggtagcacatactacgcgagctgggcgaaaggc | cgattcaccatctccaaaacct |
| Ab26 | ttcattagtagtagtagtagcatagattatgtgagttgggcgaaaggc | cgattcaccatctccaaaacct |
| Ab27 | tgcatgtattggtggttggtagtggtgtgccacttattacgcgagctgggcgaaaggc | cgattcaccatctccaaaacct |
| Ab28 | gtcatttatgttattggtgtcactgactacgcgagctctgcgcaaggc | cgattcaccatctccagagaca |

Figure 54D
Antibody Heavy chain DNA features

| Sequence Name | FR3 |
|---|---|
| Ab1 | cgaccacggtggatctgagaatccccagtccgacaaccgaggacacggccacctatttctgtgccaga |
| Ab2 | attccaagaacacaccctgtatcttcaaatgaacagcctgagacagcctgaggacactgctgtgtattactgtgccaga |
| Ab3 | cgaccacggtggatctgaaaatcaccagtccgacaaccgaggacacggccacatatttctgtgccaga |
| Ab4 | cgaccaccctggatcttaagatgaccagcagcctgagacagcctgaggacactgctacatattactgtgccaga |
| Ab5 | cgaccacggtggatctgaaaatcaccagtccgacaaccgaggacacggccacctatttctgtgccagg |
| Ab6 | cgaccacggtggatctgaaaatcccccagtccgacaaccgaggacacggccacctatttctgtgccaga |
| Ab7 | cgaccacggtggatctgaaaatcccccagtccgacaaccgaggacacggccacctatttctgtgccaga |
| Ab8 | attccaagaacacaccctgtatctcaaatgaacagcctgagagcctgaggacactgctgtgtattactgtgccaga |
| Ab9 | cgtcgaccacggtggatctgaaaatcaccagtccgacaaccgaggacaacgagcctgaggacacggccacctatttctgtaccaga |
| Ab10 | attccaagaacacaccctgtatcttcaaatgaacagcctgagacagcctgaggacactgctgtgtattactgtgctaga |
| Ab11 | cgaccacggtggatctgaaaatcaccagtccgacaaccgaggacacggccacctatttctgtgccaga |
| Ab12 | cgaccacggtggatctgaaaatgaccagtccgacaaccgaggacacggccacctatttctgtgccaga |
| Ab13 | attccaagaacacaccctgtatctcaaatgaacagcctgagacagcctgaggacactgctgtgtattactgtgctaga |
| Ab14 | cgaccacggtggatctgaaaatcaccagtccgacaaccgaggacacggccacctatttctgtgccaga |
| Ab15 | cgaccacggtggatctgaaaatcaccagtccgacaaccgaggacacggccacctatttctgtgccaga |
| Ab16 | cgcccacggtggatctgaaaatcaccagtccgacaaccgaggacacggccacctatttctgtgccaga |
| Ab17 | cgaccacggtggatctgaaaatgaccagtccgacaaccgaggacacggccacctatttctgtgccaga |
| Ab18 | cgaccacggtggatctgaaaatgaccagtccgacaaccgaggacacggccatctatttctgtgccaga |
| Ab19 | cgaccacggtggatctgaaaatgaccagtccgacaccgagcctgaggacacggccacctatttctgtgccaca |
| Ab20 | attccaagaacacaccctgtatcttcaaatgaacagcctgagacagcctgaggacactgctgtgtattactgtgccaga |
| Ab21 | cgaccacggtggatctgaaaatgaccagtccgacaaccgaggacacggccacctatttctgtgccaga |
| Ab23 | cgaccacggtggatctgaaaatcaccagtccgacaaccgaggacacggccacctatttctgtgccaga |
| Ab24 | attccaagaacacaccctgtatcttcaaatgaacagcctgagacagcctgaggacactgctgtgtattactgtgctaga |
| Ab25 | cgaccacggtggagctgatctgaaaatcaccagtccgacaaccgaggacacggccacctatttctgtgccaga |
| Ab26 | cgaccacggtggatctgaaaatcaccagtccgacaaccgaggacacggccacctatttctgtgccaga |
| Ab27 | cgtcgaccacggtgactctgcaaatgaccagtccgacagccgcggacagccgaggacagctgagagctgcgaga |
| Ab28 | attccaagaacacaccctgtatcttcaaatgaacagcctgagacagcctgaggacactgctgtgtattactgtgctaga |

Figure 54E
Antibody Heavy chain DNA features

| Sequence Name | CDR3 |
|---|---|
| Ab1 | gtttatgattctgtctgaatcactttaacttg |
| Ab2 | gtttatgattctgtctgaatcacttcaacttg |
| Ab3 | gaggggatagtaatgactggggtgtctttgacttg |
| Ab4 | gaggggatagtaatgactggggtgtctttgacttg |
| Ab5 | aaatttgatacgggatatgacatc |
| Ab6 | gtttatgattctggctggaatcactttaacttg |
| Ab7 | gtttatgattctggctggaatcactttaacttg |
| Ab8 | gtttatgattctggctggaatcactttaacttg |
| Ab9 | ggggagtatgctggtgtgttgttggttcgaactactttgacttg |
| Ab10 | ggggagtatgctggtgtgttgttggttcgaactactttgacttg |
| Ab11 | gataaagatgctagtagtggtggtgttattggtcctgacctattggatgtccccgacggcatggacctc |
| Ab12 | gtttatgattctggctggaatcactttaacttg |
| Ab13 | gtttatgattctggctggaatcactttaacttg |
| Ab14 | tgggatgctgaaaacaatgagattcttaacttg |
| Ab15 | tgggatgctgaaaacaatgagattcttaacttg |
| Ab16 | ttgattgacgagcgttcaacttatagttatgttttttgacttg |
| Ab17 | ttgattgacgagcgttcaacttatagttatgctttttgacttg |
| Ab18 | gtgggttatagtggttatgttatgataatttggacatg |
| Ab19 | gtcaattatcctgattatagtactggtgcctttaacatc |
| Ab20 | gtcaattatcctgattatagtactggtgcctttaacatc |
| Ab21 | catattgatagtagtggctgggatggactgggcatc |
| Ab22 | gtgggtggtttaatgactactctgacatt |
| Ab23 | gtgggtggtttaatgactactctgacatt |
| Ab24 | gtgggtggttcaatgactactctgacatt |
| Ab25 | ggtagtggtgtcgttttttcccaactactttgccatc |
| Ab26 | gattttatgctgattatattggtggtggttatccttacatc |
| Ab27 | gatgattggactagtatatgctgtggggtattgggccttg |
| Ab28 | gtttatgattctgctgctgaatcactttaacttg |

Figure 54F
Antibody Heavy chain DNA features

| Sequence Name | FR4 | Constant region |
|---|---|---|
| Ab1 | tggggcccggggcaccctgtcaccgtctcgagc | gcctccaccaagggcccatcggtcttccccctggcacccctcct |
| Ab2 | tggggccaaggggaccctcgtcaccgtctcgagc | gcctccaccaagggcccatcggtcttccccctggcacccctcct |
| Ab3 | tggggccaagggcaccctggtcaccgtctcgagc | gcctccaccaagggcccatcggtcttccccctggcacccctcct |
| Ab4 | tggggccaagggcaccctcgtcaccgtctcgagc | gcctccaccaagggcccatcggtcttccccctggcacccctcct |
| Ab5 | tggggcccaggcaccctcgtcaccgtctcgagc | gcctccaccaagggcccatcggtcttccccctggcacccctcct |
| Ab6 | tggggcccggggcaccctcgtcaccgtctcgagc | gcctccaccaagggcccatcggtcttccccctggcacccctcct |
| Ab7 | tggggcccaggaccctcgtcaccgtctcgagc | gcctccaccaagggcccatcggtcttccccctggcacccctcct |
| Ab8 | tggggccaagggaccctcgtcaccgtctcgagc | gcctccaccaagggcccatcggtcttccccctggcacccctcct |
| Ab9 | tggggccaagggcaccctcgtcaccgtctcgagc | gcctccaccaagggcccatcggtcttccccctggcacccctcct |
| Ab10 | tggggcccaggcaccctcgtcaccgtctcgagc | gcctccaccaagggcccatcggtcttccccctggcacccctcct |
| Ab11 | tggggcccaggcaccctcgtcaccgtctcgagc | gcctccaccaagggcccatcggtcttccccctggcacccctcct |
| Ab12 | tggggcccaggcaccctcgtcaccgtctcgagc | gcctccaccaagggcccatcggtcttccccctggcacccctcct |
| Ab13 | tggggccaagggaccctcgtcaccgtctcgagc | gcctccaccaagggcccatcggtcttccccctggcacccctcct |
| Ab14 | tggggccaagggaccctcgtcaccgtctcgagc | gcctccaccaagggcccatcggtcttccccctggcacccctcct |
| Ab15 | tggggcccaggccaccctcgtcaccgtctcgagc | gcctccaccaagggcccatcggtcttccccctggcacccctcct |
| Ab16 | tggggccaagggcaccctggtcaccgtctcgagc | gcctccaccaagggcccatcggtcttccccctggcacccctcct |
| Ab17 | tggggccaagggcaccctcgtcaccgtctcgagc | gcctccaccaagggcccatcggtcttccccctggcacccctcct |
| Ab18 | tggggccaagggaccctcgtcaccgtctcgagc | gcctccaccaagggcccatcggtcttccccctggcacccctcct |
| Ab19 | tggggccaagggaccctcgtcaccgtctcgagc | gcctccaccaagggcccatcggtcttccccctggcacccctcct |
| Ab20 | tggggccaagggaccctggtcaccgtctcgagc | gcctccaccaagggcccatcggtcttccccctggcacccctcct |
| Ab21 | tggggccaagggcaccctggtcaccgtctcgagc | gcctccaccaagggcccatcggtcttccccctggcacccctcct |
| Ab23 | tggggccaagggaccctggtcaccgtctcgagc | gcctccaccaagggcccatcggtcttccccctggcacccctcct |
| Ab24 | tggggccaagggaccctcgtcaccgtctcgagc | gcctccaccaagggcccatcggtcttccccctggcacccctcct |
| Ab25 | tggggcccaggcaccctcgtcaccgtctcgagc | gcctccaccaagggcccatcggtcttccccctggcacccctcct |
| Ab26 | tggggcccggggcaccctcgtcaccgtctcgagc | gcctccaccaagggcccatcggtcttccccctggcacccctcct |
| Ab27 | tggggcccggggcaccctcgtcaccgtctcgagc | gcctccaccaagggcccatcggtcttccccctggcacccctcct |
| Ab28 | tggggccaagggaccctcgtcaccgtctcgagc | gcctccaccaagggcccatcggtcttccccctggcacccctcct |

Figure 54G
Antibody Heavy chain DNA features

| Sequence Name | Constant region |
|---|---|
| Ab1 | ccaagagcacctctgggggcacagcggccctgggctgcctggtcaaggactacttccccgaaccggtgacggtgt |
| Ab2 | ccaagagcacctctgggggcacagcggccctgggctgcctggtcaaggactacttccccgaaccggtgacggtgt |
| Ab3 | ccaagagcacctctgggggcacagcggccctgggctgcctggtcaaggactacttccccgaaccggtgacggtgt |
| Ab4 | ccaagagcacctctgggggcacagcggccctgggctgcctggtcaaggactacttccccgaaccggtgacggtgt |
| Ab5 | ccaagagcacctctgggggcacagcggccctgggctgcctggtcaaggactacttccccgaaccggtgacggtgt |
| Ab6 | ccaagagcacctctgggggcacagcggccctgggctgcctggtcaaggactacttccccgaaccggtgacggtgt |
| Ab7 | ccaagagcacctctgggggcacagcggccctgggctgcctggtcaaggactacttccccgaaccggtgacggtgt |
| Ab8 | ccaagagcacctctgggggcacagcggccctgggctgcctggtcaaggactacttccccgaaccggtgacggtgt |
| Ab9 | ccaagagcacctctgggggcacagcggccctgggctgcctggtcaaggactacttccccgaaccggtgacggtgt |
| Ab10 | ccaagagcacctctgggggcacagcggccctgggctgcctggtcaaggactacttccccgaaccggtgacggtgt |
| Ab11 | ccaagagcacctctgggggcacagcggccctgggctgcctggtcaaggactacttccccgaaccggtgacggtgt |
| Ab12 | ccaagagcacctctgggggcacagcggccctgggctgcctggtcaaggactacttccccgaaccggtgacggtgt |
| Ab13 | ccaagagcacctctgggggcacagcggccctgggctgcctggtcaaggactacttccccgaaccggtgacggtgt |
| Ab14 | ccaagagcacctctgggggcacagcggccctgggctgcctggtcaaggactacttccccgaaccggtgacggtgt |
| Ab15 | ccaagagcacctctgggggcacagcggccctgggctgcctggtcaaggactacttccccgaaccggtgacggtgt |
| Ab16 | ccaagagcacctctgggggcacagcggccctgggctgcctggtcaaggactacttccccgaaccggtgacggtgt |
| Ab17 | ccaagagcacctctgggggcacagcggccctgggctgcctggtcaaggactacttccccgaaccggtgacggtgt |
| Ab18 | ccaagagcacctctgggggcacagcggccctgggctgcctggtcaaggactacttccccgaaccggtgacggtgt |
| Ab19 | ccaagagcacctctgggggcacagcggccctgggctgcctggtcaaggactacttccccgaaccggtgacggtgt |
| Ab20 | ccaagagcacctctgggggcacagcggccctgggctgcctggtcaaggactacttccccgaaccggtgacggtgt |
| Ab21 | ccaagagcacctctgggggcacagcggccctgggctgcctggtcaaggactacttccccgaaccggtgacggtgt |
| Ab23 | ccaagagcacctctgggggcacagcggccctgggctgcctggtcaaggactacttccccgaaccggtgacggtgt |
| Ab24 | ccaagagcacctctgggggcacagcggccctgggctgcctggtcaaggactacttccccgaaccggtgacggtgt |
| Ab25 | ccaagagcacctctgggggcacagcggccctgggctgcctggtcaaggactacttccccgaaccggtgacggtgt |
| Ab26 | ccaagagcacctctgggggcacagcggccctgggctgcctggtcaaggactacttccccgaaccggtgacggtgt |
| Ab27 | ccaagagcacctctgggggcacagcggccctgggctgcctggtcaaggactacttccccgaaccggtgacggtgt |
| Ab28 | ccaagagcacctctgggggcacagcggccctgggctgcctggtcaaggactacttccccgaaccggtgacggtgt |

Figure 54H
Antibody Heavy chain DNA features

| Sequence Name | Constant region |
|---|---|
| Ab1 | cgtggaactcaggcgccctgaccagcggcgtgcacacctccggcgtgtcctacagtcctcaggactctactccc |
| Ab2 | cgtggaactcaggcgccctgaccagcggcgtgcacacctccggcgtgtcctacagtcctcaggactctactccc |
| Ab3 | cgtggaactcaggcgccctgaccagcggcgtgcacacctccggcgtgtcctacagtcctcaggactctactccc |
| Ab4 | cgtggaactcaggcgccctgaccagcggcgtgcacacctccggcgtgtcctacagtcctcaggactctactccc |
| Ab5 | cgtggaactcaggcgccctgaccagcggcgtgcacacctccggcgtgtcctacagtcctcaggactctactccc |
| Ab6 | cgtggaactcaggcgccctgaccagcggcgtgcacacctccggcgtgtcctacagtcctcaggactctactccc |
| Ab7 | cgtggaactcaggcgccctgaccagcggcgtgcacacctccggcgtgtcctacagtcctcaggactctactccc |
| Ab8 | cgtggaactcaggcgccctgaccagcggcgtgcacacctccggcgtgtcctacagtcctcaggactctactccc |
| Ab9 | cgtggaactcaggcgccctgaccagcggcgtgcacacctccggcgtgtcctacagtcctcaggactctactccc |
| Ab10 | cgtggaactcaggcgccctgaccagcggcgtgcacacctccggcgtgtcctacagtcctcaggactctactccc |
| Ab11 | cgtggaactcaggcgccctgaccagcggcgtgcacacctccggcgtgtcctacagtcctcaggactctactccc |
| Ab12 | cgtggaactcaggcgccctgaccagcggcgtgcacacctccggcgtgtcctacagtcctcaggactctactccc |
| Ab13 | cgtggaactcaggcgccctgaccagcggcgtgcacacctccggcgtgtcctacagtcctcaggactctactccc |
| Ab14 | cgtggaactcaggcgccctgaccagcggcgtgcacacctccggcgtgtcctacagtcctcaggactctactccc |
| Ab15 | cgtggaactcaggcgccctgaccagcggcgtgcacacctccggcgtgtcctacagtcctcaggactctactccc |
| Ab16 | cgtggaactcaggcgccctgaccagcggcgtgcacacctccggcgtgtcctacagtcctcaggactctactccc |
| Ab17 | cgtggaactcaggcgccctgaccagcggcgtgcacacctccggcgtgtcctacagtcctcaggactctactccc |
| Ab18 | cgtggaactcaggcgccctgaccagcggcgtgcacacctccggcgtgtcctacagtcctcaggactctactccc |
| Ab19 | cgtggaactcaggcgccctgaccagcggcgtgcacacctccggcgtgtcctacagtcctcaggactctactccc |
| Ab20 | cgtggaactcaggcgccctgaccagcggcgtgcacacctccggcgtgtcctacagtcctcaggactctactccc |
| Ab21 | cgtggaactcaggcgccctgaccagcggcgtgcacacctccggcgtgtcctacagtcctcaggactctactccc |
| Ab23 | cgtggaactcaggcgccctgaccagcggcgtgcacacctccggcgtgtcctacagtcctcaggactctactccc |
| Ab24 | cgtggaactcaggcgccctgaccagcggcgtgcacacctccggcgtgtcctacagtcctcaggactctactccc |
| Ab25 | cgtggaactcaggcgccctgaccagcggcgtgcacacctccggcgtgtcctacagtcctcaggactctactccc |
| Ab26 | cgtggaactcaggcgccctgaccagcggcgtgcacacctccggcgtgtcctacagtcctcaggactctactccc |
| Ab27 | cgtggaactcaggcgccctgaccagcggcgtgcacacctccggcgtgtcctacagtcctcaggactctactccc |
| Ab28 | cgtggaactcaggcgccctgaccagcggcgtgcacacctccggcgtgtcctacagtcctcaggactctactccc |

Figure 54I
Antibody Heavy chain DNA features

| Sequence Name | Constant region |
|---|---|
| Ab1 | tcagcagcgtggtgaccgtgccctccagcagcttgggcacccagacctacatctgcaacgtgaatcacaagccca |
| Ab2 | tcagcagcgtggtgaccgtgccctccagcagcttgggcacccagacctacatctgcaacgtgaatcacaagccca |
| Ab3 | tcagcagcgtggtgaccgtgccctccagcagcttgggcacccagacctacatctgcaacgtgaatcacaagccca |
| Ab4 | tcagcagcgtggtgaccgtgccctccagcagcttgggcacccagacctacatctgcaacgtgaatcacaagccca |
| Ab5 | tcagcagcgtggtgaccgtgccctccagcagcttgggcacccagacctacatctgcaacgtgaatcacaagccca |
| Ab6 | tcagcagcgtggtgaccgtgccctccagcagcttgggcacccagacctacatctgcaacgtgaatcacaagccca |
| Ab7 | tcagcagcgtggtgaccgtgccctccagcagcttgggcacccagacctacatctgcaacgtgaatcacaagccca |
| Ab8 | tcagcagcgtggtgaccgtgccctccagcagcttgggcacccagacctacatctgcaacgtgaatcacaagccca |
| Ab9 | tcagcagcgtggtgaccgtgccctccagcagcttgggcacccagacctacatctgcaacgtgaatcacaagccca |
| Ab10 | tcagcagcgtggtgaccgtgccctccagcagcttgggcacccagacctacatctgcaacgtgaatcacaagccca |
| Ab11 | tcagcagcgtggtgaccgtgccctccagcagcttgggcacccagacctacatctgcaacgtgaatcacaagccca |
| Ab12 | tcagcagcgtggtgaccgtgccctccagcagcttgggcacccagacctacatctgcaacgtgaatcacaagccca |
| Ab13 | tcagcagcgtggtgaccgtgccctccagcagcttgggcacccagacctacatctgcaacgtgaatcacaagccca |
| Ab14 | tcagcagcgtggtgaccgtgccctccagcagcttgggcacccagacctacatctgcaacgtgaatcacaagccca |
| Ab15 | tcagcagcgtggtgaccgtgccctccagcagcttgggcacccagacctacatctgcaacgtgaatcacaagccca |
| Ab16 | tcagcagcgtggtgaccgtgccctccagcagcttgggcacccagacctacatctgcaacgtgaatcacaagccca |
| Ab17 | tcagcagcgtggtgaccgtgccctccagcagcttgggcacccagacctacatctgcaacgtgaatcacaagccca |
| Ab18 | tcagcagcgtggtgaccgtgccctccagcagcttgggcacccagacctacatctgcaacgtgaatcacaagccca |
| Ab19 | tcagcagcgtggtgaccgtgccctccagcagcttgggcacccagacctacatctgcaacgtgaatcacaagccca |
| Ab20 | tcagcagcgtggtgaccgtgccctccagcagcttgggcacccagacctacatctgcaacgtgaatcacaagccca |
| Ab21 | tcagcagcgtggtgaccgtgccctccagcagcttgggcacccagacctacatctgcaacgtgaatcacaagccca |
| Ab23 | tcagcagcgtggtgaccgtgccctccagcagcttgggcacccagacctacatctgcaacgtgaatcacaagccca |
| Ab24 | tcagcagcgtggtgaccgtgccctccagcagcttgggcacccagacctacatctgcaacgtgaatcacaagccca |
| Ab25 | tcagcagcgtggtgaccgtgccctccagcagcttgggcacccagacctacatctgcaacgtgaatcacaagccca |
| Ab26 | tcagcagcgtggtgaccgtgccctccagcagcttgggcacccagacctacatctgcaacgtgaatcacaagccca |
| Ab27 | tcagcagcgtggtgaccgtgccctccagcagcttgggcacccagacctacatctgcaacgtgaatcacaagccca |
| Ab28 | tcagcagcgtggtgaccgtgccctccagcagcttgggcacccagacctacatctgcaacgtgaatcacaagccca |

Figure 54J
Antibody Heavy chain DNA features

| Sequence Name | Constant region |
|---|---|
| Ab1 | gcaacaccaaggtggacaagagagagttgagcccaaatcttgtgacaaaactcacacatgcccaccgtgcccagcac |
| Ab2 | gcaacaccaaggtggacaagagagagttgagcccaaatcttgtgacaaaactcacacatgcccaccgtgcccagcac |
| Ab3 | gcaacaccaaggtggacaagagagagttgagcccaaatcttgtgacaaaactcacacatgcccaccgtgcccagcac |
| Ab4 | gcaacaccaaggtggacaagagagagttgagcccaaatcttgtgacaaaactcacacatgcccaccgtgcccagcac |
| Ab5 | gcaacaccaaggtggacaagagagagttgagcccaaatcttgtgacaaaactcacacatgcccaccgtgcccagcac |
| Ab6 | gcaacaccaaggtggacaagagagagttgagcccaaatcttgtgacaaaactcacacatgcccaccgtgcccagcac |
| Ab7 | gcaacaccaaggtggacaagagagagttgagcccaaatcttgtgacaaaactcacacatgcccaccgtgcccagcac |
| Ab8 | gcaacaccaaggtggacaagagagagttgagcccaaatcttgtgacaaaactcacacatgcccaccgtgcccagcac |
| Ab9 | gcaacaccaaggtggacaagagagagttgagcccaaatcttgtgacaaaactcacacatgcccaccgtgcccagcac |
| Ab10 | gcaacaccaaggtggacaagagagagttgagcccaaatcttgtgacaaaactcacacatgcccaccgtgcccagcac |
| Ab11 | gcaacaccaaggtggacaagagagagttgagcccaaatcttgtgacaaaactcacacatgcccaccgtgcccagcac |
| Ab12 | gcaacaccaaggtggacaagagagagttgagcccaaatcttgtgacaaaactcacacatgcccaccgtgcccagcac |
| Ab13 | gcaacaccaaggtggacaagagagagttgagcccaaatcttgtgacaaaactcacacatgcccaccgtgcccagcac |
| Ab14 | gcaacaccaaggtggacaagagagagttgagcccaaatcttgtgacaaaactcacacatgcccaccgtgcccagcac |
| Ab15 | gcaacaccaaggtggacaagagagagttgagcccaaatcttgtgacaaaactcacacatgcccaccgtgcccagcac |
| Ab16 | gcaacaccaaggtggacaagagagagttgagcccaaatcttgtgacaaaactcacacatgcccaccgtgcccagcac |
| Ab17 | gcaacaccaaggtggacaagagagagttgagcccaaatcttgtgacaaaactcacacatgcccaccgtgcccagcac |
| Ab18 | gcaacaccaaggtggacaagagagagttgagcccaaatcttgtgacaaaactcacacatgcccaccgtgcccagcac |
| Ab19 | gcaacaccaaggtggacaagagagagttgagcccaaatcttgtgacaaaactcacacatgcccaccgtgcccagcac |
| Ab20 | gcaacaccaaggtggacaagagagagttgagcccaaatcttgtgacaaaactcacacatgcccaccgtgcccagcac |
| Ab21 | gcaacaccaaggtggacaagagagagttgagcccaaatcttgtgacaaaactcacacatgcccaccgtgcccagcac |
| Ab23 | gcaacaccaaggtggacaagagagagttgagcccaaatcttgtgacaaaactcacacatgcccaccgtgcccagcac |
| Ab24 | gcaacaccaaggtggacaagagagagttgagcccaaatcttgtgacaaaactcacacatgcccaccgtgcccagcac |
| Ab25 | gcaacaccaaggtggacaagagagagttgagcccaaatcttgtgacaaaactcacacatgcccaccgtgcccagcac |
| Ab26 | gcaacaccaaggtggacaagagagagttgagcccaaatcttgtgacaaaactcacacatgcccaccgtgcccagcac |
| Ab27 | gcaacaccaaggtggacaagagagagttgagcccaaatcttgtgacaaaactcacacatgcccaccgtgcccagcac |
| Ab28 | gcaacaccaaggtggacgagcgagagtttgagcccaaatcttgtgacaaaactcacacatgcccaccgtgcccagcac |

Figure 54K
Antibody Heavy chain DNA features

| Sequence Name | Constant region |
|---|---|
| Ab1 | ctgaactcctgggggaccgtcagtcttcctcttcccccccaaaacccaaggacaccctcatgatctcccgaccc |
| Ab2 | ctgaactcctgggggaccgtcagtcttcctcttcccccccaaaacccaaggacaccctcatgatctcccgaccc |
| Ab3 | ctgaactcctgggggaccgtcagtcttcctcttcccccccaaaacccaaggacaccctcatgatctcccgaccc |
| Ab4 | ctgaactcctgggggaccgtcagtcttcctcttcccccccaaaacccaaggacaccctcatgatctcccgaccc |
| Ab5 | ctgaactcctgggggaccgtcagtcttcctcttcccccccaaaacccaaggacaccctcatgatctcccgaccc |
| Ab6 | ctgaactcctgggggaccgtcagtcttcctcttcccccccaaaacccaaggacaccctcatgatctcccgaccc |
| Ab7 | ctgaactcctgggggaccgtcagtcttcctcttcccccccaaaacccaaggacaccctcatgatctcccgaccc |
| Ab8 | ctgaactcctgggggaccgtcagtcttcctcttcccccccaaaacccaaggacaccctcatgatctcccgaccc |
| Ab9 | ctgaactcctgggggaccgtcagtcttcctcttcccccccaaaacccaaggacaccctcatgatctcccgaccc |
| Ab10 | ctgaactcctgggggaccgtcagtcttcctcttcccccccaaaacccaaggacaccctcatgatctcccgaccc |
| Ab11 | ctgaactcctgggggaccgtcagtcttcctcttcccccccaaaacccaaggacaccctcatgatctcccgaccc |
| Ab12 | ctgaactcctgggggaccgtcagtcttcctcttcccccccaaaacccaaggacaccctcatgatctcccgaccc |
| Ab13 | ctgaactcctgggggaccgtcagtcttcctcttcccccccaaaacccaaggacaccctcatgatctcccgaccc |
| Ab14 | ctgaactcctgggggaccgtcagtcttcctcttcccccccaaaacccaaggacaccctcatgatctcccgaccc |
| Ab15 | ctgaactcctgggggaccgtcagtcttcctcttcccccccaaaacccaaggacaccctcatgatctcccgaccc |
| Ab16 | ctgaactcctgggggaccgtcagtcttcctcttcccccccaaaacccaaggacaccctcatgatctcccgaccc |
| Ab17 | ctgaactcctgggggaccgtcagtcttcctcttcccccccaaaacccaaggacaccctcatgatctcccgaccc |
| Ab18 | ctgaactcctgggggaccgtcagtcttcctcttcccccccaaaacccaaggacaccctcatgatctcccgaccc |
| Ab19 | ctgaactcctgggggaccgtcagtcttcctcttcccccccaaaacccaaggacaccctcatgatctcccgaccc |
| Ab20 | ctgaactcctgggggaccgtcagtcttcctcttcccccccaaaacccaaggacaccctcatgatctcccgaccc |
| Ab21 | ctgaactcctgggggaccgtcagtcttcctcttcccccccaaaacccaaggacaccctcatgatctcccgaccc |
| Ab23 | ctgaactcctgggggaccgtcagtcttcctcttcccccccaaaacccaaggacaccctcatgatctcccgaccc |
| Ab24 | ctgaactcctgggggaccgtcagtcttcctcttcccccccaaaacccaaggacaccctcatgatctcccgaccc |
| Ab25 | ctgaactcctgggggaccgtcagtcttcctcttcccccccaaaacccaaggacaccctcatgatctcccgaccc |
| Ab26 | ctgaactcctgggggaccgtcagtcttcctcttcccccccaaaacccaaggacaccctcatgatctcccgaccc |
| Ab27 | ctgaactcctgggggaccgtcagtcttcctcttcccccccaaaacccaaggacaccctcatgatctcccgaccc |
| Ab28 | ctgaactcctgggggaccgtcagtcttcctcttcccccccaaaacccaaggacaccctcatgatctcccgaccc |

Figure 54L
Antibody Heavy chain DNA features

| Sequence Name | Constant region |
|---|---|
| Ab1 | ctgaggtcacatgcgtggtggtgacgtggacgtgagccacgaagaccctgaggtcaagttcaactggtacgtggacggcg |
| Ab2 | ctgaggtcacatgcgtggtggtgacgtggacgtgagccacgaagaccctgaggtcaagttcaactggtacgtggacggcg |
| Ab3 | ctgaggtcacatgcgtggtggtgacgtggacgtgagccacgaagaccctgaggtcaagttcaactggtacgtggacggcg |
| Ab4 | ctgaggtcacatgcgtggtggtgacgtggacgtgagccacgaagaccctgaggtcaagttcaactggtacgtggacggcg |
| Ab5 | ctgaggtcacatgcgtggtggtgacgtggacgtgagccacgaagaccctgaggtcaagttcaactggtacgtggacggcg |
| Ab6 | ctgaggtcacatgcgtggtggtgacgtggacgtgagccacgaagaccctgaggtcaagttcaactggtacgtggacggcg |
| Ab7 | ctgaggtcacatgcgtggtggtgacgtggacgtgagccacgaagaccctgaggtcaagttcaactggtacgtggacggcg |
| Ab8 | ctgaggtcacatgcgtggtggtgacgtggacgtgagccacgaagaccctgaggtcaagttcaactggtacgtggacggcg |
| Ab9 | ctgaggtcacatgcgtggtggtgacgtggacgtgagccacgaagaccctgaggtcaagttcaactggtacgtggacggcg |
| Ab10 | ctgaggtcacatgcgtggtggtgacgtggacgtgagccacgaagaccctgaggtcaagttcaactggtacgtggacggcg |
| Ab11 | ctgaggtcacatgcgtggtggtgacgtggacgtgagccacgaagaccctgaggtcaagttcaactggtacgtggacggcg |
| Ab12 | ctgaggtcacatgcgtggtggtgacgtggacgtgagccacgaagaccctgaggtcaagttcaactggtacgtggacggcg |
| Ab13 | ctgaggtcacatgcgtggtggtgacgtggacgtgagccacgaagaccctgaggtcaagttcaactggtacgtggacggcg |
| Ab14 | ctgaggtcacatgcgtggtggtgacgtggacgtgagccacgaagaccctgaggtcaagttcaactggtacgtggacggcg |
| Ab15 | ctgaggtcacatgcgtggtggtgacgtggacgtgagccacgaagaccctgaggtcaagttcaactggtacgtggacggcg |
| Ab16 | ctgaggtcacatgcgtggtggtgacgtggacgtgagccacgaagaccctgaggtcaagttcaactggtacgtggacggcg |
| Ab17 | ctgaggtcacatgcgtggtggtgacgtggacgtgagccacgaagaccctgaggtcaagttcaactggtacgtggacggcg |
| Ab18 | ctgaggtcacatgcgtggtggtgacgtggacgtgagccacgaagaccctgaggtcaagttcaactggtacgtggacggcg |
| Ab19 | ctgaggtcacatgcgtggtggtgacgtggacgtgagccacgaagaccctgaggtcaagttcaactggtacgtggacggcg |
| Ab20 | ctgaggtcacatgcgtggtggtgacgtggacgtgagccacgaagaccctgaggtcaagttcaactggtacgtggacggcg |
| Ab21 | ctgaggtcacatgcgtggtggtgacgtggacgtgagccacgaagaccctgaggtcaagttcaactggtacgtggacggcg |
| Ab23 | ctgaggtcacatgcgtggtggtgacgtggacgtgagccacgaagaccctgaggtcaagttcaactggtacgtggacggcg |
| Ab24 | ctgaggtcacatgcgtggtggtgacgtggacgtgagccacgaagaccctgaggtcaagttcaactggtacgtggacggcg |
| Ab25 | ctgaggtcacatgcgtggtggtgacgtggacgtgagccacgaagaccctgaggtcaagttcaactggtacgtggacggcg |
| Ab26 | ctgaggtcacatgcgtggtggtgacgtggacgtgagccacgaagaccctgaggtcaagttcaactggtacgtggacggcg |
| Ab27 | ctgaggtcacatgcgtggtggtgacgtggacgtgagccacgaagaccctgaggtcaagttcaactggtacgtggacggcg |
| Ab28 | ctgaggtcacatgcgtggtggtgacgtggacgtgagccacgaagaccctgaggtcaagttcaactggtacgtggacggcg |

Figure 54M
Antibody Heavy chain DNA features

| Sequence Name | Constant region |
|---|---|
| Ab1 | tggaggtgcataatgccaagacaaagccgcggagacaaagccgcagcagtacgccagcgtgtggtcagcgtcctca |
| Ab2 | tggaggtgcataatgccaagacaaagccgcggagacaaagccgcagcagtacgccagcgtgtggtcagcgtcctca |
| Ab3 | tggaggtgcataatgccaagacaaagccgcggagacaaagccgcagcagtacgccagcgtgtggtcagcgtcctca |
| Ab4 | tggaggtgcataatgccaagacaaagccgcggagacaaagccgcagcagtacgccagcgtgtggtcagcgtcctca |
| Ab5 | tggaggtgcataatgccaagacaaagccgcggagacaaagccgcagcagtacgccagcgtgtggtcagcgtcctca |
| Ab6 | tggaggtgcataatgccaagacaaagccgcggagacaaagccgcagcagtacgccagcgtgtggtcagcgtcctca |
| Ab7 | tggaggtgcataatgccaagacaaagccgcggagacaaagccgcagcagtacgccagcgtgtggtcagcgtcctca |
| Ab8 | tggaggtgcataatgccaagacaaagccgcggagacaaagccgcagcagtacgccagcgtgtggtcagcgtcctca |
| Ab9 | tggaggtgcataatgccaagacaaagccgcggagacaaagccgcagcagtacgccagcgtgtggtcagcgtcctca |
| Ab10 | tggaggtgcataatgccaagacaaagccgcggagacaaagccgcagcagtacgccagcgtgtggtcagcgtcctca |
| Ab11 | tggaggtgcataatgccaagacaaagccgcggagacaaagccgcagcagtacgccagcgtgtggtcagcgtcctca |
| Ab12 | tggaggtgcataatgccaagacaaagccgcggagacaaagccgcagcagtacgccagcgtgtggtcagcgtcctca |
| Ab13 | tggaggtgcataatgccaagacaaagccgcggagacaaagccgcagcagtacgccagcgtgtggtcagcgtcctca |
| Ab14 | tggaggtgcataatgccaagacaaagccgcggagacaaagccgcagcagtacgccagcgtgtggtcagcgtcctca |
| Ab15 | tggaggtgcataatgccaagacaaagccgcggagacaaagccgcagcagtacgccagcgtgtggtcagcgtcctca |
| Ab16 | tggaggtgcataatgccaagacaaagccgcggagacaaagccgcagcagtacgccagcgtgtggtcagcgtcctca |
| Ab17 | tggaggtgcataatgccaagacaaagccgcggagacaaagccgcagcagtacgccagcgtgtggtcagcgtcctca |
| Ab18 | tggaggtgcataatgccaagacaaagccgcggagacaaagccgcagcagtacgccagcgtgtggtcagcgtcctca |
| Ab19 | tggaggtgcataatgccaagacaaagccgcggagacaaagccgcagcagtacgccagcgtgtggtcagcgtcctca |
| Ab20 | tggaggtgcataatgccaagacaaagccgcggagacaaagccgcagcagtacgccagcgtgtggtcagcgtcctca |
| Ab21 | tggaggtgcataatgccaagacaaagccgcggagacaaagccgcagcagtacgccagcgtgtggtcagcgtcctca |
| Ab23 | tggaggtgcataatgccaagacaaagccgcggagacaaagccgcagcagtacgccagcgtgtggtcagcgtcctca |
| Ab24 | tggaggtgcataatgccaagacaaagccgcggagacaaagccgcagcagtacgccagcgtgtggtcagcgtcctca |
| Ab25 | tggaggtgcataatgccaagacaaagccgcggagacaaagccgcagcagtacgccagcgtgtggtcagcgtcctca |
| Ab26 | tggaggtgcataatgccaagacaaagccgcggagacaaagccgcagcagtacgccagcgtgtggtcagcgtcctca |
| Ab27 | tggaggtgcataatgccaagacaaagccgcggagacaaagccgcagcagtacgccagcgtgtggtcagcgtcctca |
| Ab28 | tggaggtgcataatgccaagacaaagccgcggagacaaagccgcagcagtacgccagcgtgtggtcagcgtcctca |

Figure 54N
Antibody Heavy chain DNA features

| Sequence Name | Constant region |
|---|---|
| Ab1 | ccgtcctgcaccaggactggctgaatgcctgaaggagtacaagtgcaaggtctccaacaacaagcccctcccagcccca |
| Ab2 | ccgtcctgcaccaggactggctgaatgcctgaaggagtacaagtgcaaggtctccaacaacaagcccctcccagcccca |
| Ab3 | ccgtcctgcaccaggactggctgaatgcctgaaggagtacaagtgcaaggtctccaacaacaagcccctcccagcccca |
| Ab4 | ccgtcctgcaccaggactggctgaatgcctgaaggagtacaagtgcaaggtctccaacaacaagcccctcccagcccca |
| Ab5 | ccgtcctgcaccaggactggctgaatgcctgaaggagtacaagtgcaaggtctccaacaacaagcccctcccagcccca |
| Ab6 | ccgtcctgcaccaggactggctgaatgcctgaaggagtacaagtgcaaggtctccaacaacaagcccctcccagcccca |
| Ab7 | ccgtcctgcaccaggactggctgaatgcctgaaggagtacaagtgcaaggtctccaacaacaagcccctcccagcccca |
| Ab8 | ccgtcctgcaccaggactggctgaatgcctgaaggagtacaagtgcaaggtctccaacaacaagcccctcccagcccca |
| Ab9 | ccgtcctgcaccaggactggctgaatgcctgaaggagtacaagtgcaaggtctccaacaacaagcccctcccagcccca |
| Ab10 | ccgtcctgcaccaggactggctgaatgcctgaaggagtacaagtgcaaggtctccaacaacaagcccctcccagcccca |
| Ab11 | ccgtcctgcaccaggactggctgaatgcctgaaggagtacaagtgcaaggtctccaacaacaagcccctcccagcccca |
| Ab12 | ccgtcctgcaccaggactggctgaatgcctgaaggagtacaagtgcaaggtctccaacaacaagcccctcccagcccca |
| Ab13 | ccgtcctgcaccaggactggctgaatgcctgaaggagtacaagtgcaaggtctccaacaacaagcccctcccagcccca |
| Ab14 | ccgtcctgcaccaggactggctgaatgcctgaaggagtacaagtgcaaggtctccaacaacaagcccctcccagcccca |
| Ab15 | ccgtcctgcaccaggactggctgaatgcctgaaggagtacaagtgcaaggtctccaacaacaagcccctcccagcccca |
| Ab16 | ccgtcctgcaccaggactggctgaatgcctgaaggagtacaagtgcaaggtctccaacaacaagcccctcccagcccca |
| Ab17 | ccgtcctgcaccaggactggctgaatgcctgaaggagtacaagtgcaaggtctccaacaacaagcccctcccagcccca |
| Ab18 | ccgtcctgcaccaggactggctgaatgcctgaaggagtacaagtgcaaggtctccaacaacaagcccctcccagcccca |
| Ab19 | ccgtcctgcaccaggactggctgaatgcctgaaggagtacaagtgcaaggtctccaacaacaagcccctcccagcccca |
| Ab20 | ccgtcctgcaccaggactggctgaatgcctgaaggagtacaagtgcaaggtctccaacaacaagcccctcccagcccca |
| Ab21 | ccgtcctgcaccaggactggctgaatgcctgaaggagtacaagtgcaaggtctccaacaacaagcccctcccagcccca |
| Ab23 | ccgtcctgcaccaggactggctgaatgcctgaaggagtacaagtgcaaggtctccaacaacaagcccctcccagcccca |
| Ab24 | ccgtcctgcaccaggactggctgaatgcctgaaggagtacaagtgcaaggtctccaacaacaagcccctcccagcccca |
| Ab25 | ccgtcctgcaccaggactggctgaatgcctgaaggagtacaagtgcaaggtctccaacaacaagcccctcccagcccca |
| Ab26 | ccgtcctgcaccaggactggctgaatgcctgaaggagtacaagtgcaaggtctccaacaacaagcccctcccagcccca |
| Ab27 | ccgtcctgcaccaggactggctgaatgcctgaaggagtacaagtgcaaggtctccaacaacaagcccctcccagcccca |
| Ab28 | ccgtcctgcaccaggactggctgaatgcctgaaggagtacaagtgcaaggtctccaacaacaagcccctcccagcccca |

Figure 540
Antibody Heavy chain DNA features

| Sequence Name | Constant region |
|---|---|
| Ab1 | tcgagaaaaccatctccaaagccaaaggggcagcccgagaaccacaggtgtacaccctgcccccatcccgggagg |
| Ab2 | tcgagaaaaccatctccaaagccaaaggggcagcccgagaaccacaggtgtacaccctgcccccatcccgggagg |
| Ab3 | tcgagaaaaccatctccaaagccaaaggggcagcccgagaaccacaggtgtacaccctgcccccatcccgggagg |
| Ab4 | tcgagaaaaccatctccaaagccaaaggggcagcccgagaaccacaggtgtacaccctgcccccatcccgggagg |
| Ab5 | tcgagaaaaccatctccaaagccaaaggggcagcccgagaaccacaggtgtacaccctgcccccatcccgggagg |
| Ab6 | tcgagaaaaccatctccaaagccaaaggggcagcccgagaaccacaggtgtacaccctgcccccatcccgggagg |
| Ab7 | tcgagaaaaccatctccaaagccaaaggggcagcccgagaaccacaggtgtacaccctgcccccatcccgggagg |
| Ab8 | tcgagaaaaccatctccaaagccaaaggggcagcccgagaaccacaggtgtacaccctgcccccatcccgggagg |
| Ab9 | tcgagaaaaccatctccaaagccaaaggggcagcccgagaaccacaggtgtacaccctgcccccatcccgggagg |
| Ab10 | tcgagaaaaccatctccaaagccaaaggggcagcccgagaaccacaggtgtacaccctgcccccatcccgggagg |
| Ab11 | tcgagaaaaccatctccaaagccaaaggggcagcccgagaaccacaggtgtacaccctgcccccatcccgggagg |
| Ab12 | tcgagaaaaccatctccaaagccaaaggggcagcccgagaaccacaggtgtacaccctgcccccatcccgggagg |
| Ab13 | tcgagaaaaccatctccaaagccaaaggggcagcccgagaaccacaggtgtacaccctgcccccatcccgggagg |
| Ab14 | tcgagaaaaccatctccaaagccaaaggggcagcccgagaaccacaggtgtacaccctgcccccatcccgggagg |
| Ab15 | tcgagaaaaccatctccaaagccaaaggggcagcccgagaaccacaggtgtacaccctgcccccatcccgggagg |
| Ab16 | tcgagaaaaccatctccaaagccaaaggggcagcccgagaaccacaggtgtacaccctgcccccatcccgggagg |
| Ab17 | tcgagaaaaccatctccaaagccaaaggggcagcccgagaaccacaggtgtacaccctgcccccatcccgggagg |
| Ab18 | tcgagaaaaccatctccaaagccaaaggggcagcccgagaaccacaggtgtacaccctgcccccatcccgggagg |
| Ab19 | tcgagaaaaccatctccaaagccaaaggggcagcccgagaaccacaggtgtacaccctgcccccatcccgggagg |
| Ab20 | tcgagaaaaccatctccaaagccaaaggggcagcccgagaaccacaggtgtacaccctgcccccatcccgggagg |
| Ab21 | tcgagaaaaccatctccaaagccaaaggggcagcccgagaaccacaggtgtacaccctgcccccatcccgggagg |
| Ab23 | tcgagaaaaccatctccaaagccaaaggggcagcccgagaaccacaggtgtacaccctgcccccatcccgggagg |
| Ab24 | tcgagaaaaccatctccaaagccaaaggggcagcccgagaaccacaggtgtacaccctgcccccatcccgggagg |
| Ab25 | tcgagaaaaccatctccaaagccaaaggggcagcccgagaaccacaggtgtacaccctgcccccatcccgggagg |
| Ab26 | tcgagaaaaccatctccaaagccaaaggggcagcccgagaaccacaggtgtacaccctgcccccatcccgggagg |
| Ab27 | tcgagaaaaccatctccaaagccaaaggggcagcccgagaaccacaggtgtacaccctgcccccatcccgggagg |
| Ab28 | tcgagaaaaccatctccaaagccaaaggggcagcccgagaaccacaggtgtacaccctgcccccatcccgggagg |

Figure 54P
Antibody Heavy chain DNA features

| Sequence Name | Constant region |
|---|---|
| Ab1 | agatgaccaagaaccaggtcagcctgacctgcctggtcaaaggcttctatcccagcgacatcgccgtggagtggg |
| Ab2 | agatgaccaagaaccaggtcagcctgacctgcctggtcaaaggcttctatcccagcgacatcgccgtggagtggg |
| Ab3 | agatgaccaagaaccaggtcagcctgacctgcctggtcaaaggcttctatcccagcgacatcgccgtggagtggg |
| Ab4 | agatgaccaagaaccaggtcagcctgacctgcctggtcaaaggcttctatcccagcgacatcgccgtggagtggg |
| Ab5 | agatgaccaagaaccaggtcagcctgacctgcctggtcaaaggcttctatcccagcgacatcgccgtggagtggg |
| Ab6 | agatgaccaagaaccaggtcagcctgacctgcctggtcaaaggcttctatcccagcgacatcgccgtggagtggg |
| Ab7 | agatgaccaagaaccaggtcagcctgacctgcctggtcaaaggcttctatcccagcgacatcgccgtggagtggg |
| Ab8 | agatgaccaagaaccaggtcagcctgacctgcctggtcaaaggcttctatcccagcgacatcgccgtggagtggg |
| Ab9 | agatgaccaagaaccaggtcagcctgacctgcctggtcaaaggcttctatcccagcgacatcgccgtggagtggg |
| Ab10 | agatgaccaagaaccaggtcagcctgacctgcctggtcaaaggcttctatcccagcgacatcgccgtggagtggg |
| Ab11 | agatgaccaagaaccaggtcagcctgacctgcctggtcaaaggcttctatcccagcgacatcgccgtggagtggg |
| Ab12 | agatgaccaagaaccaggtcagcctgacctgcctggtcaaaggcttctatcccagcgacatcgccgtggagtggg |
| Ab13 | agatgaccaagaaccaggtcagcctgacctgcctggtcaaaggcttctatcccagcgacatcgccgtggagtggg |
| Ab14 | agatgaccaagaaccaggtcagcctgacctgcctggtcaaaggcttctatcccagcgacatcgccgtggagtggg |
| Ab15 | agatgaccaagaaccaggtcagcctgacctgcctggtcaaaggcttctatcccagcgacatcgccgtggagtggg |
| Ab16 | agatgaccaagaaccaggtcagcctgacctgcctggtcaaaggcttctatcccagcgacatcgccgtggagtggg |
| Ab17 | agatgaccaagaaccaggtcagcctgacctgcctggtcaaaggcttctatcccagcgacatcgccgtggagtggg |
| Ab18 | agatgaccaagaaccaggtcagcctgacctgcctggtcaaaggcttctatcccagcgacatcgccgtggagtggg |
| Ab19 | agatgaccaagaaccaggtcagcctgacctgcctggtcaaaggcttctatcccagcgacatcgccgtggagtggg |
| Ab20 | agatgaccaagaaccaggtcagcctgacctgcctggtcaaaggcttctatcccagcgacatcgccgtggagtggg |
| Ab21 | agatgaccaagaaccaggtcagcctgacctgcctggtcaaaggcttctatcccagcgacatcgccgtggagtggg |
| Ab23 | agatgaccaagaaccaggtcagcctgacctgcctggtcaaaggcttctatcccagcgacatcgccgtggagtggg |
| Ab24 | agatgaccaagaaccaggtcagcctgacctgcctggtcaaaggcttctatcccagcgacatcgccgtggagtggg |
| Ab25 | agatgaccaagaaccaggtcagcctgacctgcctggtcaaaggcttctatcccagcgacatcgccgtggagtggg |
| Ab26 | agatgaccaagaaccaggtcagcctgacctgcctggtcaaaggcttctatcccagcgacatcgccgtggagtggg |
| Ab27 | agatgaccaagaaccaggtcagcctgacctgcctggtcaaaggcttctatcccagcgacatcgccgtggagtggg |
| Ab28 | agatgaccaagaaccaggtcagcctgacctgcctggtcaaaggcttctatcccagcgacatcgccgtggagtggg |

Figure 54Q
Antibody Heavy chain DNA features

| Sequence Name | Constant region |
|---|---|
| Ab1 | agagcaatgggcagccgcagccggagaacaactacaagaccaccacgcctcccgtgctgctggactccgacggctcctcttcctct |
| Ab2 | agagcaatgggcagccgcagccggagaacaactacaagaccaccacgcctcccgtgctgctggactccgacggctcctcttcctct |
| Ab3 | agagcaatgggcagccgcagccggagaacaactacaagaccaccacgcctcccgtgctgctggactccgacggctcctcttcctct |
| Ab4 | agagcaatgggcagccgcagccggagaacaactacaagaccaccacgcctcccgtgctgctggactccgacggctcctcttcctct |
| Ab5 | agagcaatgggcagccgcagccggagaacaactacaagaccaccacgcctcccgtgctgctggactccgacggctcctcttcctct |
| Ab6 | agagcaatgggcagccgcagccggagaacaactacaagaccaccacgcctcccgtgctgctggactccgacggctcctcttcctct |
| Ab7 | agagcaatgggcagccgcagccggagaacaactacaagaccaccacgcctcccgtgctgctggactccgacggctcctcttcctct |
| Ab8 | agagcaatgggcagccgcagccggagaacaactacaagaccaccacgcctcccgtgctgctggactccgacggctcctcttcctct |
| Ab9 | agagcaatgggcagccgcagccggagaacaactacaagaccaccacgcctcccgtgctgctggactccgacggctcctcttcctct |
| Ab10 | agagcaatgggcagccgcagccggagaacaactacaagaccaccacgcctcccgtgctgctggactccgacggctcctcttcctct |
| Ab11 | agagcaatgggcagccgcagccggagaacaactacaagaccaccacgcctcccgtgctgctggactccgacggctcctcttcctct |
| Ab12 | agagcaatgggcagccgcagccggagaacaactacaagaccaccacgcctcccgtgctgctggactccgacggctcctcttcctct |
| Ab13 | agagcaatgggcagccgcagccggagaacaactacaagaccaccacgcctcccgtgctgctggactccgacggctcctcttcctct |
| Ab14 | agagcaatgggcagccgcagccggagaacaactacaagaccaccacgcctcccgtgctgctggactccgacggctcctcttcctct |
| Ab15 | agagcaatgggcagccgcagccggagaacaactacaagaccaccacgcctcccgtgctgctggactccgacggctcctcttcctct |
| Ab16 | agagcaatgggcagccgcagccggagaacaactacaagaccaccacgcctcccgtgctgctggactccgacggctcctcttcctct |
| Ab17 | agagcaatgggcagccgcagccggagaacaactacaagaccaccacgcctcccgtgctgctggactccgacggctcctcttcctct |
| Ab18 | agagcaatgggcagccgcagccggagaacaactacaagaccaccacgcctcccgtgctgctggactccgacggctcctcttcctct |
| Ab19 | agagcaatgggcagccgcagccggagaacaactacaagaccaccacgcctcccgtgctgctggactccgacggctcctcttcctct |
| Ab20 | agagcaatgggcagccgcagccggagaacaactacaagaccaccacgcctcccgtgctgctggactccgacggctcctcttcctct |
| Ab21 | agagcaatgggcagccgcagccggagaacaactacaagaccaccacgcctcccgtgctgctggactccgacggctcctcttcctct |
| Ab23 | agagcaatgggcagccgcagccggagaacaactacaagaccaccacgcctcccgtgctgctggactccgacggctcctcttcctct |
| Ab24 | agagcaatgggcagccgcagccggagaacaactacaagaccaccacgcctcccgtgctgctggactccgacggctcctcttcctct |
| Ab25 | agagcaatgggcagccgcagccggagaacaactacaagaccaccacgcctcccgtgctgctggactccgacggctcctcttcctct |
| Ab26 | agagcaatgggcagccgcagccggagaacaactacaagaccaccacgcctcccgtgctgctggactccgacggctcctcttcctct |
| Ab27 | agagcaatgggcagccgcagccggagaacaactacaagaccaccacgcctcccgtgctgctggactccgacggctcctcttcctct |
| Ab28 | agagcaatgggcagccgcagccggagaacaactacaagaccaccacgcctcccgtgctgctggactccgacggctcctcttcctct |

Figure 54R
Antibody Heavy chain DNA features

| Sequence Name | Constant region |
|---|---|
| Ab1 | acagcaagctcaccgtggacaagagagcaggtggcagcaggggaacgtcttctcatgctcctcgtgatgcatgaggctc |
| Ab2 | acagcaagctcaccgtggacaagagagcaggtggcagcaggggaacgtcttctcatgctcctcgtgatgcatgaggctc |
| Ab3 | acagcaagctcaccgtggacaagagagcaggtggcagcaggggaacgtcttctcatgctcctcgtgatgcatgaggctc |
| Ab4 | acagcaagctcaccgtggacaagagagcaggtggcagcaggggaacgtcttctcatgctcctcgtgatgcatgaggctc |
| Ab5 | acagcaagctcaccgtggacaagagagcaggtggcagcaggggaacgtcttctcatgctcctcgtgatgcatgaggctc |
| Ab6 | acagcaagctcaccgtggacaagagagcaggtggcagcaggggaacgtcttctcatgctcctcgtgatgcatgaggctc |
| Ab7 | acagcaagctcaccgtggacaagagagcaggtggcagcaggggaacgtcttctcatgctcctcgtgatgcatgaggctc |
| Ab8 | acagcaagctcaccgtggacaagagagcaggtggcagcaggggaacgtcttctcatgctcctcgtgatgcatgaggctc |
| Ab9 | acagcaagctcaccgtggacaagagagcaggtggcagcaggggaacgtcttctcatgctcctcgtgatgcatgaggctc |
| Ab10 | acagcaagctcaccgtggacaagagagcaggtggcagcaggggaacgtcttctcatgctcctcgtgatgcatgaggctc |
| Ab11 | acagcaagctcaccgtggacaagagagcaggtggcagcaggggaacgtcttctcatgctcctcgtgatgcatgaggctc |
| Ab12 | acagcaagctcaccgtggacaagagagcaggtggcagcaggggaacgtcttctcatgctcctcgtgatgcatgaggctc |
| Ab13 | acagcaagctcaccgtggacaagagagcaggtggcagcaggggaacgtcttctcatgctcctcgtgatgcatgaggctc |
| Ab14 | acagcaagctcaccgtggacaagagagcaggtggcagcaggggaacgtcttctcatgctcctcgtgatgcatgaggctc |
| Ab15 | acagcaagctcaccgtggacaagagagcaggtggcagcaggggaacgtcttctcatgctcctcgtgatgcatgaggctc |
| Ab16 | acagcaagctcaccgtggacaagagagcaggtggcagcaggggaacgtcttctcatgctcctcgtgatgcatgaggctc |
| Ab17 | acagcaagctcaccgtggacaagagagcaggtggcagcaggggaacgtcttctcatgctcctcgtgatgcatgaggctc |
| Ab18 | acagcaagctcaccgtggacaagagagcaggtggcagcaggggaacgtcttctcatgctcctcgtgatgcatgaggctc |
| Ab19 | acagcaagctcaccgtggacaagagagcaggtggcagcaggggaacgtcttctcatgctcctcgtgatgcatgaggctc |
| Ab20 | acagcaagctcaccgtggacaagagagcaggtggcagcaggggaacgtcttctcatgctcctcgtgatgcatgaggctc |
| Ab21 | acagcaagctcaccgtggacaagagagcaggtggcagcaggggaacgtcttctcatgctcctcgtgatgcatgaggctc |
| Ab23 | acagcaagctcaccgtggacaagagagcaggtggcagcaggggaacgtcttctcatgctcctcgtgatgcatgaggctc |
| Ab24 | acagcaagctcaccgtggacaagagagcaggtggcagcaggggaacgtcttctcatgctcctcgtgatgcatgaggctc |
| Ab25 | acagcaagctcaccgtggacaagagagcaggtggcagcaggggaacgtcttctcatgctcctcgtgatgcatgaggctc |
| Ab26 | acagcaagctcaccgtggacaagagagcaggtggcagcaggggaacgtcttctcatgctcctcgtgatgcatgaggctc |
| Ab27 | acagcaagctcaccgtggacaagagagcaggtggcagcaggggaacgtcttctcatgctcctcgtgatgcatgaggctc |
| Ab28 | acagcaagctcaccgtggacaagagagcaggtggcagcaggggaacgtcttctcatgctcctcgtgatgcatgaggctc |

Figure 54S
Antibody Heavy chain DNA features

| Sequence Name | Constant region | |
|---|---|---|
| Ab1 | tgcacaaccactacacgcagaagagccctctccctgtctccgggtaaa | (SEQ ID NO:11) |
| Ab2 | tgcacaaccactacacgcagaagagccctctccctgtctccgggtaaa | (SEQ ID NO:51) |
| Ab3 | tgcacaaccactacacgcagaagagccctctccctgtctccgggtaaa | (SEQ ID NO:91) |
| Ab4 | tgcacaaccactacacgcagaagagccctctccctgtctccgggtaaa | (SEQ ID NO:131) |
| Ab5 | tgcacaaccactacacgcagaagagccctctccctgtctccgggtaaa | (SEQ ID NO:171) |
| Ab6 | tgcacaaccactacacgcagaagagccctctccctgtctccgggtaaa | (SEQ ID NO:211) |
| Ab7 | tgcacaaccactacacgcagaagagccctctccctgtctccgggtaaa | (SEQ ID NO:251) |
| Ab8 | tgcacaaccactacacgcagaagagccctctccctgtctccgggtaaa | (SEQ ID NO:291) |
| Ab9 | tgcacaaccactacacgcagaagagccctctccctgtctccgggtaaa | (SEQ ID NO:331) |
| Ab10 | tgcacaaccactacacgcagaagagccctctccctgtctccgggtaaa | (SEQ ID NO:371) |
| Ab11 | tgcacaaccactacacgcagaagagccctctccctgtctccgggtaaa | (SEQ ID NO:411) |
| Ab12 | tgcacaaccactacacgcagaagagccctctccctgtctccgggtaaa | (SEQ ID NO:451) |
| Ab13 | tgcacaaccactacacgcagaagagccctctccctgtctccgggtaaa | (SEQ ID NO:491) |
| Ab14 | tgcacaaccactacacgcagaagagccctctccctgtctccgggtaaa | (SEQ ID NO:531) |
| Ab15 | tgcacaaccactacacgcagaagagccctctccctgtctccgggtaaa | (SEQ ID NO:571) |
| Ab16 | tgcacaaccactacacgcagaagagccctctccctgtctccgggtaaa | (SEQ ID NO:611) |
| Ab17 | tgcacaaccactacacgcagaagagccctctccctgtctccgggtaaa | (SEQ ID NO:651) |
| Ab18 | tgcacaaccactacacgcagaagagccctctccctgtctccgggtaaa | (SEQ ID NO:691) |
| Ab19 | tgcacaaccactacacgcagaagagccctctccctgtctccgggtaaa | (SEQ ID NO:731) |
| Ab20 | tgcacaaccactacacgcagaagagccctctccctgtctccgggtaaa | (SEQ ID NO:771) |
| Ab21 | tgcacaaccactacacgcagaagagccctctccctgtctccgggtaaa | (SEQ ID NO:811) |
| Ab23 | tgcacaaccactacacgcagaagagccctctccctgtctccgggtaaa | (SEQ ID NO:851) |
| Ab24 | tgcacaaccactacacgcagaagagccctctccctgtctccgggtaaa | (SEQ ID NO:891) |
| Ab25 | tgcacaaccactacacgcagaagagccctctccctgtctccgggtaaa | (SEQ ID NO:931) |
| Ab26 | tgcacaaccactacacgcagaagagccctctccctgtctccgggtaaa | (SEQ ID NO:971) |
| Ab27 | tgcacaaccactacacgcagaagagccctctccctgtctccgggtaaa | (SEQ ID NO:1011) |
| Ab28 | tgcacaaccactacacgcagaagagccctctccctgtctccgggtaaa | (SEQ ID NO:1051) |

Figure 55A
Antibody Light chain DNA features

| Sequence Name | FR1 |
|---|---|
| Ab1 | gcctatgatatgacccagactccagcctctgtggagtagctgtgggggcacagtcaccatcaagtgc |
| Ab2 | gacatccagatgacccagtctctccttccaccctgtctgtctcagtctcctgtaggagacagagtcaccatcacttgc |
| Ab3 | gcctatgatatgacccagactccagcctctgtagagatagctgtgggaggcacagtcaccatcaggtgc |
| Ab4 | gcctatgatatgacccagtctccagcctctgtccgtggaggcagccgtgggaggcacagtcaccatcaggtgt |
| Ab5 | gcctatgatatgacccagactccagcctctatggaggtagctgtgggaggcacagtcaccatcaagtgc |
| Ab6 | gctgacattgtgatgacccagactccatcctccgtgtggaggcagctgtgggaggcacagtcaccatcaagtgc |
| Ab7 | gcctatgatatgacccagactccagcctctgtgtggaggtagctgtgggaggcacagtcaccatcaagtgc |
| Ab8 | gacatccagatgacccagtctcttccaccctgtctgcagttgtctgcagctgtgggagacagagtcaccatcacttgc |
| Ab9 | caagtgctgacccagactccacactccgtgtctgcagtctctgcagctgtgggaggcacagtcaccatcaattgc |
| Ab10 | gacatccagatgacccagtctctccatcttccgtgtctgcagtctctgtaggagacagagtcaccatcacttgt |
| Ab11 | gccgtgctgacccagacaccagcctccagcctctgtgggctgtctctgcagctgtgggaggcacagtcaccatcaagtgc |
| Ab12 | gcctatgatatgacccagactccagcctctgtccttccacccctgtctctgcagctgtgggaggtagctgtgggaggcacagtcaccatcaagtgc |
| Ab13 | gactatcagatatgacccagactccagcctctcttccacccctgtctgcagctgtgggaggtagctgtgggagacagagtcaccatcacttgc |
| Ab14 | gcctatgatatgacccagactccagcctctgtgtggaggcagctgtgggaggcacagtcaccatcaagtgc |
| Ab15 | gcctatgatatgacccagactccagcctccccctgtctgtctccgtgtggaggtagctgtgggaggcacagtcaccatcaagtgc |
| Ab16 | caagtgctgacccagactccatcccccctgtctgtctccgtgtggaggcacagtcaccatcaactgc |
| Ab17 | caagtgctgacccagactccatcccccctgtctgtctccgtgtggaggcacagtcaccatcaactgc |
| Ab18 | gcctatgatatgacccagactccagcctctgtggaggtagctgtgggaggcacagtcaccatcaagtgc |
| Ab19 | gatgttgtgatgacccagactccagcctccagcctctgtgtctgaacctgtgggaggcacagtcaccatcaagtgc |
| Ab20 | gacatccagatgacccagactccagcctctgtcctccatcctccgtctctgtaggagacagagtcaccatcacttgc |
| Ab21 | gcctatgatatgacccagactccagcctctgtgtggaggtagctgtgggaggcacagtcaccatcaagtgc |
| Ab23 | gcctatgatatgacccagactccagcctctgtggaggtagctgtgggaggcacagtcaccatcaagtgc |
| Ab24 | gacatccagatgacccagtctccagcctctgtctctgtaggagacagagtcaccatcacttgc |
| Ab25 | caagtgctgacccagactgcatgtccgtcctgcagctgtgggaggcacagtcaccatcagttgc |
| Ab26 | gccgatgttgtgatgacccagactccagactccgtgtctgaacctgtgggaggcacagtcaccatcaagtgc |
| Ab27 | gctgacattgtgatgacccagaatccagcctccgtgtctgaacctgtgggaggcacagtcaccatcaagtgc |
| Ab28 | gacatccagatgacccagtctccttccacccctgtctctgcatctgtaggagacagagtcaccatcacttgc |

Figure 55B
Antibody Light chain DNA features

| Sequence Name | CDR1 | FR2 |
|---|---|---|
| Ab1 | caggccagtcagagcattagcagcagttggttagcc | tggtatcagcagaaaccagggcagcctcccaagctcc |
| Ab2 | caggccagtcagagcattagcagtcagttggttagcc | tggtatcagcagaaaccagggcagaaagccctaagctcc |
| Ab3 | caggccagtcagagcattgagacagtcagttgaaagctatttagcc | tggtatcagcagaaaccagggcagcctcccaaactcc |
| Ab4 | caggccagtcagagcattgagacagtcagaagctacttagcc | tggtatcagcagaaaccagggcagcctcctaagctcc |
| Ab5 | caggccagtcagagcattagtagtacctacttagcc | tggtatcagcagaaaccagggcagcctcccaagctcc |
| Ab6 | caggccagtcagagagaacatttataggttattggcc | tggtatcagcagaaaccagggcagcgtcccaagctcc |
| Ab7 | caggccagtcagagcattagcagtcagttggttagcc | tggtatcagcagaaaccagggcagcctccaaagctcc |
| Ab8 | caggccagtcagagcattagcagtcagttggttagcc | tggtatcagcagaaaccaggcagaaaagccccaagctcc |
| Ab9 | cagtccagtcagagagattttatagtaattggttatct | tggtatcagcagaaaccagggcagactcccaagctcc |
| Ab10 | cagtccagtcagagatctatagtagtaattggttatct | tggtatcagcagaaaccagggcagaaagccctaagctcc |
| Ab11 | cagtccagtcagagtgttttatataacaacctcttatcc | tggtatcagcagaaaccagggcagcctcccaagctcc |
| Ab12 | caggtcagtcagagcattagtagtagttggttatcc | tggtatcagcagaagaaaccagggcagcgtcccaagctcc |
| Ab13 | caggtcagtcagagcattagtagtagttggttagcc | tggtatcagcagaaaccagggcagaaaagcccctaagctcc |
| Ab14 | caggccagtcagagagcattgaaagctatttagcc | tggtatcagcagaaaccagggcagcctcccaagctcc |
| Ab15 | caggccagtcagagagcattagtagctactttagcc | tggtatcagcagaaatcagggcagcctcccaagctcc |
| Ab16 | cagggccagtcagagtctttataataacaacgcctttcc | tggtatcagcagaaaccagggcagcctcccaagctcc |
| Ab17 | caggccagtcagagagtttttatataacaacggcgccttttcc | tggtatcagcagaaaccagggcagcctcccaagctcc |
| Ab18 | caggccagtcagagcattagcactgcattagcc | tggtatcagcagaaaccagggcagcgtcccaagctcc |
| Ab19 | caggccagtcagagcattgataactacttagcc | tggtatcagcagaaaccagggcagcgtcccaagctcc |
| Ab20 | caggccagtcagagcattgataactactagcc | tggtatcagcagaaaccagggaaagttcctaagctcc |
| Ab21 | caggccagtcagagcattagtagctactagcc | tggtatcagcagaaaccagggcagcctcccaagctcc |
| Ab23 | caggccagtcagagcattagtagtacctactagcc | tggtatcagcagaaactagggcagcctcccaagctcc |
| Ab24 | caggccagtcagagcattagtagtacctactagcc | tggtatcagcagaaaccagggcagcctcccaagctcc |
| Ab25 | cagtccagtcagagtgttactaataacaacgactagcc | tggtatcagcagaaaccagggaaagttcctaagctcc |
| Ab26 | caggccagtcagagcattgtactaataacaacgactagcc | tggtatcagcagaaaccagggcagcctcccaagctcc |
| Ab27 | caggccagtcagagcgttaatagttggttagcc | tggtatcagcagaaaccagggcagcctcccaagttcc |
| Ab28 | caggccagtcagagcattagcagttggttagcc | tggtatcagcagaaaccagggaaaagccccctaagctcc |

Figure 55C
Antibody Light chain DNA features

| Sequence Name | FR2 | CDR2 | FR3 |
|---|---|---|---|
| Ab1 | tgatctac | caggcatctaaactggcatct | ggggtcccatcgcggttcaaaggcagtggatcggatctgggacagagttca |
| Ab2 | tgatctat | caggcatctaaactggcatct | ggagtcccatcaaggttcagcggcagtggatctggatctggaacagaattca |
| Ab3 | tgatctac | agggcatccgatctggcatct | ggggtctcatcgcggttcaaaggcagtggatctggatctgggacagactaca |
| Ab4 | tgatctat | agggcatccgatctggcatct | ggggtctcatcaaggttcaaaggcagtggatctggatctgggacagattaca |
| Ab5 | tgatctat | gatgcatccgatctggcatct | ggggtctcatcgcggttcaaaggcagtggatctggatctgggacacagttca |
| Ab6 | tgatctat | tctgcatccactctggcatct | ggggtctcatcgcggttcaaaggcagtggatctggatctgggacacagttca |
| Ab7 | tgatctac | gaagcatccaaactggcatct | ggggtcccatcgcggttcagtggcagtggatctggatctgggacacagttca |
| Ab8 | tgatctat | gaagcatccaaactggcatct | ggagtcccatcaaggttcagcggcagtggatctggatctggaacagaattca |
| Ab9 | tgatctat | gctgcatccagcctggcatct | ggggtcccatcaaggttcagcggcagtggatctggatctgggacacagttca |
| Ab10 | tgatctac | gctgcatccagcctggcatct | ggggtcccatcaaggttcagcggcagtggatctggatctgggacagattca |
| Ab11 | tgatctgg | ggtgcatcctatctgccatct | ggggtcccagataggttcagcggcagtggatctggatctgggacacagttca |
| Ab12 | tgatctac | agggcatccactctggcatct | ggggtctcatcgcggttcaaaggcagtggatctggatctgggacagagttca |
| Ab13 | tgatctat | agggcatccactctggcatct | ggagtcccatcaaggttcgcggcagtggatctggatctgggaacagaattca |
| Ab14 | tgatctac | agggcttccactctggcatct | ggggtctcatcgcggttcaaaggcagtggatctggatctgggacacagttca |
| Ab15 | tgatctat | agggcttccactctggcatct | ggggtctcatcgcggttcaaaggcagtggatctggatctgggacacagttca |
| Ab16 | tgatctat | gatgcttccactctggcgtct | ggggtcccatcgcggttcaaaggcagtggatctggatctgggacacagttca |
| Ab17 | tgatctac | gatgcatccactctggcatct | ggggtcccatcgcggttcaaaggcagtggatctggatctgggacacagttca |
| Ab18 | tgatctac | gatgcatcgaaactctggcat | ggggtcccatcgcggttcaaaggcagtggatctggatctgggacacagttca |
| Ab19 | tgatctat | tatacatccactctgccatct | ggggtcccatcgcggttcaaaggcagtggatctggatctgggacagagtaca |
| Ab20 | tgatctat | tatacatccactctgccatct | ggggtcccatctcgtttcagtgcagtggatctggatctgggacagatttca |
| Ab21 | tgatctac | agggcatccactctgacatct | ggggtcccatcaaggttcaaaggcagtggatctggatctgggacagagttca |
| Ab23 | tgatctac | agggcatccactctggcatct | ggggtctcatcgcggttcaaaggcagtggatctggatctgggacacagttca |
| Ab24 | tgatctat | agggcatccactctggcatct | ggggtcccatctcgtttcagtggcagtggatctggatctgggacagatttca |
| Ab25 | tgatctac | caggcatccaaactggcatct | ggggtcccatcgcggttcaaaggcagtggatctggatctgggacacagttca |
| Ab26 | tgatctat | ggtgcatccaaactgacatct | ggggtcccatcgcggttcaaaggcagtggatctggatctgggacagagttca |
| Ab27 | tgatctac | aaagcatccactctggcatct | ggggtctcatcgcggttcaaaggcagtggatgggattgggacagagttca |
| Ab28 | tgatctat | gaagcatccaaactggcatct | ggagtcccatccaaggttcagcggcagtggatctggatctgaacagaattca |

Figure 55D
Antibody Light chain DNA features

| Sequence Name | FR3 | CDR3 |
|---|---|---|
| Ab1 | ctctcaccatcagcggcgtggagtgtgccgatgctgccacttactattgt | caacaggcttatagtgttagtaatg |
| Ab2 | ctctcaccatcagcggcgtggagtgtgccgatgattttgcaacttattgc | caacaggcttatagtgttagtaatg |
| Ab3 | ctctcaccatcagcggcgtggagtgtggacgatgctgccacttactactgt | caacagggttatactatcgataatg |
| Ab4 | ctctcaccatcagcggcctggagcctgaagatgctgcaacttactattgt | caacaggttatactatcgataatg |
| Ab5 | ctctcaccatcagcgcgtggagtgtgacgatgctgccacttactactgt | caacaggattggagtgatagtaatg |
| Ab6 | ctctcaccatcagcagcgaccttggagtgtgccgatgctgccacttactactgt | caaaactattattatagtagtagga |
| Ab7 | ctctcaccatcagcggcgtggagtgtgccgatgctgccacttactactgt | caacaggcttatagtgttgccaatg |
| Ab8 | ctctcaccatcagcggcgtgcagcctgatgattttgcaacttattactgc | caacaggcttatagtgttgccaatg |
| Ab9 | ctctcaccatcagcagcgacctggagtgtgacgatgctgccagttactactgt | gcaggctattagtggtcatattt |
| Ab10 | ctctcaccatcagcagcgacctgcagcctgaagattttgcaacttactactgt | gcaggctactatagtggtcatatct |
| Ab11 | ctctcaccatcagcggcgtgcagtgtgacgatgctgccgatgctgccacttactactgt | ctaggcggttatgatgtgatgctg |
| Ab12 | ctctcaccatcagcggcgtggagtgtgccgatgctgccacttactactgt | caacaggcttatagtgttagtaatg |
| Ab13 | ctctcaccatcagcggcgtgcagcctgcagcctgatgattttgcaacttactgc | caacaggcttatagtgttagtaatg |
| Ab14 | ctctcaccatcagcggcgtggaatgtgccgatgctgccacttactactgt | caacaggtgatgcttggagtaatg |
| Ab15 | ctctcaccatcagcggcgtggagtgtgccgatgctgccacttactactgt | caacaggtgatgcttggagtaatg |
| Ab16 | ctctcaccatcagtgcgggcgtgcagtgtgacgatgctgccacttactactgt | caaggcgaattttagttgtggtgatg |
| Ab17 | ctctcaccatcagcggcgtgcagcctgcagtgtgagagatgctgccacttactgt | caaggcgaattttagtgtgtagtg |
| Ab18 | ctctcaccatcagcggcgtggagtgtgccgatgctgccacttactactgt | caccaggttatagtagtagtaatg |
| Ab19 | ctctcaccatcagcgacctgcagtgtgccgatgctgccacttactactgt | caatttactgcttattatagtactt |
| Ab20 | ctctcaccatcagcagcgaccttggagtgtgccgatgctgccacttattactgt | caatttactgcttattatagtactt |
| Ab21 | ctctcaccatcagcagcgaccttggagtgtgacgatgctgcaacttactactgt | cagcagacttatgttatagtgata |
| Ab23 | ctctcaccatcagcggcgtggagtgtgccgatgctgccacttactactgt | caacagggttatagttatagtaatg |
| Ab24 | ctctcaccatcagcagcgaccttgcagcctgaagatgttgcaacttactactgt | caacaggttatagtatagtaatg |
| Ab25 | ctctcaccatcagcggcgacctgcagcctgaagatgctgacatgctgccacttactgt | caaggcgtttatagtgtggtgtttt |
| Ab26 | ctctcaccatcagcggcgtgcagcctgcagtgtgacgatgctgccacttactgt | caaagcaattatgatatttatagtt |
| Ab27 | ctctcaccatcagcagcgaccttgcagtgtggtgtcgatgctgccacgtatattgc | caatttagtaatagtggtactattt |
| Ab28 | ctctcaccatcagcagcctgcagcctgatgattttgcaacttattactgc | caacaggcttatagtgttgccaatg |

Figure 55E
Antibody Light chain DNA features

| Sequence Name | CDR3 | FR4 | Constant region |
|---|---|---|---|
| Ab1 | ttgataatgct | ttcggcggagggaccgaggtggtggtcaaacgt | acggtggctgcaccatctg |
| Ab2 | ttgataatgct | ttcggcggagggaccaaggtggaaatcaaacgt | acggtagcggcccatctg |
| Ab3 | ttgataatact | ttcggcggagggaccgaggtggtggtcaaacgt | acggtagcggcccatctg |
| Ab4 | ttgacaatact | ttcggcggagggaccaaggtggaaatcaaacgt | acggtagcggcccatctg |
| Ab5 | ttgataatgct | ttcggcggagggaccgaggtggtggtcaaacgt | acggtagcggcccatctg |
| Ab6 | gtagttatgatacatataatgtt | ttcggcggagggaccgaggtggtggtcaaacgt | acggtagcggcccatctg |
| Ab7 | ttgataatgct | ttcggcggagggaccgaggtggtggtcaaacgt | acggtagcggcccatctg |
| Ab8 | ttgataatgct | ttcggcggagggaccaaggtggaaatcaaacgt | acggtagcggcccatctg |
| Ab9 | attct | ttcggcggagggaccgaggtggtggtcaaacgt | acggtagcggcccatctg |
| Ab10 | attct | ttcggcggagggaccgaggtggtggtcaaacgt | acggtagcggcccatctg |
| Ab11 | atacatataatact | ttcggcggagggaccgaggtggtggtcaaacgt | acggtagcggcccatctg |
| Ab12 | ttgataatgct | ttcggcggagggaccgaggtggtggtcaaacgt | acggtagcggcccatctg |
| Ab13 | ttgataatgct | ttcggcggagggaccaaggtggaaatcaaacgt | acggtgctgcaccatctg |
| Ab14 | ttgataatgtt | ttcggcggagggaccgaggtggtggtcaaacgt | acggtagcggcccatctg |
| Ab15 | ttgataatgtt | ttcggcggagggaccgaggtggtggtcaaacgt | acggtagcggcccatctg |
| Ab16 | ttgattgtattgct | ttcggcggagggaccgaggtggtggtcaaacgt | acggtagcggcccatctg |
| Ab17 | ctgattgtgttgct | ttcggcggagggaccgaggtggtggtcaaacgt | acggtagcggcccatctg |
| Ab18 | ttgataatact | ttcggcggagggaccgaggtggtggtcaaacgt | acggtagcggcccatctg |
| Ab19 | atattggagct | ttcggcggagggaccgaggtggtggtcaaacgt | acggtagcggcccatctg |
| Ab20 | acattggagct | ttcggcggagggaccaaggtggaaatcaaacgt | acggtgctgcaccatctg |
| Ab21 | ctgataattct | ttcggcggagggaccgaggtggtggtcaaacgt | acggtagcggcccatctg |
| Ab23 | ttgataatgct | ttcggcggagggaccgaggtggtggtcaaacgt | acggtagcggcccatctg |
| Ab24 | ttgataatgct | ttcggcggagggaccaaggtggaaatcaaacgt | acggtggctgcaccatctg |
| Ab25 | gtgct | ttcggcggagggaccgaggtggtggtcaaacgt | acggtagcggcccatctg |
| Ab26 | atgct | ttcggcggagggaccgaggtggtggtcaaacgt | acggtagcggcccatctg |
| Ab27 | atgggagtggt | ttcggcggagggaccgaggtggtggtcaaacgt | acggtagcggcccatctg |
| Ab28 | ttgataatgct | ttcggcggagggaccaaggtggaaatcaaacgt | acggtggctgcaccatctg |

Figure 55F
Antibody Light chain DNA features

| Sequence Name | Constant region |
|---|---|
| Ab1 | tcttcatcttcccgccatctgatgagcagttgaaatctgaactgcctcgttgttgtgcctgctgaataacttct |
| Ab2 | tcttcatcttcccgccatctgatgagcagttgaaatctgaactgcctcgttgttgtgcctgctgaataacttct |
| Ab3 | tcttcatcttcccgccatctgatgagcagttgaaatctgaactgcctcgttgttgtgcctgctgaataacttct |
| Ab4 | tcttcatcttcccgccatctgatgagcagttgaaatctgaactgcctcgttgttgtgcctgctgaataacttct |
| Ab5 | tcttcatcttcccgccatctgatgagcagttgaaatctgaactgcctcgttgttgtgcctgctgaataacttct |
| Ab6 | tcttcatcttcccgccatctgatgagcagttgaaatctgaactgcctcgttgttgtgcctgctgaataacttct |
| Ab7 | tcttcatcttcccgccatctgatgagcagttgaaatctgaactgcctcgttgttgtgcctgctgaataacttct |
| Ab8 | tcttcatcttcccgccatctgatgagcagttgaaatctgaactgcctcgttgttgtgcctgctgaataacttct |
| Ab9 | tcttcatcttcccgccatctgatgagcagttgaaatctgaactgcctcgttgttgtgcctgctgaataacttct |
| Ab10 | tcttcatcttcccgccatctgatgagcagttgaaatctgaactgcctcgttgttgtgcctgctgaataacttct |
| Ab11 | tcttcatcttcccgccatctgatgagcagttgaaatctgaactgcctcgttgttgtgcctgctgaataacttct |
| Ab12 | tcttcatcttcccgccatctgatgagcagttgaaatctgaactgcctcgttgttgtgcctgctgaataacttct |
| Ab13 | tcttcatcttcccgccatctgatgagcagttgaaatctgaactgcctcgttgttgtgcctgctgaataacttct |
| Ab14 | tcttcatcttcccgccatctgatgagcagttgaaatctgaactgcctcgttgttgtgcctgctgaataacttct |
| Ab15 | tcttcatcttcccgccatctgatgagcagttgaaatctgaactgcctcgttgttgtgcctgctgaataacttct |
| Ab16 | tcttcatcttcccgccatctgatgagcagttgaaatctgaactgcctcgttgttgtgcctgctgaataacttct |
| Ab17 | tcttcatcttcccgccatctgatgagcagttgaaatctgaactgcctcgttgttgtgcctgctgaataacttct |
| Ab18 | tcttcatcttcccgccatctgatgagcagttgaaatctgaactgcctcgttgttgtgcctgctgaataacttct |
| Ab19 | tcttcatcttcccgccatctgatgagcagttgaaatctgaactgcctcgttgttgtgcctgctgaataacttct |
| Ab20 | tcttcatcttcccgccatctgatgagcagttgaaatctgaactgcctcgttgttgtgcctgctgaataacttct |
| Ab21 | tcttcatcttcccgccatctgatgagcagttgaaatctgaactgcctcgttgttgtgcctgctgaataacttct |
| Ab23 | tcttcatcttcccgccatctgatgagcagttgaaatctgaactgcctcgttgttgtgcctgctgaataacttct |
| Ab24 | tcttcatcttcccgccatctgatgagcagttgaaatctgaactgcctcgttgttgtgcctgctgaataacttct |
| Ab25 | tcttcatcttcccgccatctgatgagcagttgaaatctgaactgcctcgttgttgtgcctgctgaataacttct |
| Ab26 | tcttcatcttcccgccatctgatgagcagttgaaatctgaactgcctcgttgttgtgcctgctgaataacttct |
| Ab27 | tcttcatcttcccgccatctgatgagcagttgaaatctgaactgcctcgttgttgtgcctgctgaataacttct |
| Ab28 | tcttcatcttcccgccatctgatgagcagttgaaatctgaactgcctcgttgttgtgcctgctgaataacttct |

Figure 55G
Antibody Light chain DNA features

| Sequence Name | Constant region |
|---|---|
| Ab1 | atcccagagaggccaaagtacagtggaaggtggataacgcccctccaatcgggtaactcccaggagagtgtcacag |
| Ab2 | atcccagagaggccaaagtacagtggaaggtggataacgcccctccaatcgggtaactcccaggagagtgtcacag |
| Ab3 | atcccagagaggccaaagtacagtggaaggtggataacgcccctccaatcgggtaactcccaggagagtgtcacag |
| Ab4 | atcccagagaggccaaagtacagtggaaggtggataacgcccctccaatcgggtaactcccaggagagtgtcacag |
| Ab5 | atcccagagaggccaaagtacagtggaaggtggataacgcccctccaatcgggtaactcccaggagagtgtcacag |
| Ab6 | atcccagagaggccaaagtacagtggaaggtggataacgcccctccaatcgggtaactcccaggagagtgtcacag |
| Ab7 | atcccagagaggccaaagtacagtggaaggtggataacgcccctccaatcgggtaactcccaggagagtgtcacag |
| Ab8 | atcccagagaggccaaagtacagtggaaggtggataacgcccctccaatcgggtaactcccaggagagtgtcacag |
| Ab9 | atcccagagaggccaaagtacagtggaaggtggataacgcccctccaatcgggtaactcccaggagagtgtcacag |
| Ab10 | atcccagagaggccaaagtacagtggaaggtggataacgcccctccaatcgggtaactcccaggagagtgtcacag |
| Ab11 | atcccagagaggccaaagtacagtggaaggtggataacgcccctccaatcgggtaactcccaggagagtgtcacag |
| Ab12 | atcccagagaggccaaagtacagtggaaggtggataacgcccctccaatcgggtaactcccaggagagtgtcacag |
| Ab13 | atcccagagaggccaaagtacagtggaaggtggataacgcccctccaatcgggtaactcccaggagagtgtcacag |
| Ab14 | atcccagagaggccaaagtacagtggaaggtggataacgcccctccaatcgggtaactcccaggagagtgtcacag |
| Ab15 | atcccagagaggccaaagtacagtggaaggtggataacgcccctccaatcgggtaactcccaggagagtgtcacag |
| Ab16 | atcccagagaggccaaagtacagtggaaggtggataacgcccctccaatcgggtaactcccaggagagtgtcacag |
| Ab17 | atcccagagaggccaaagtacagtggaaggtggataacgcccctccaatcgggtaactcccaggagagtgtcacag |
| Ab18 | atcccagagaggccaaagtacagtggaaggtggataacgcccctccaatcgggtaactcccaggagagtgtcacag |
| Ab19 | atcccagagaggccaaagtacagtggaaggtggataacgcccctccaatcgggtaactcccaggagagtgtcacag |
| Ab20 | atcccagagaggccaaagtacagtggaaggtggataacgcccctccaatcgggtaactcccaggagagtgtcacag |
| Ab21 | atcccagagaggccaaagtacagtggaaggtggataacgcccctccaatcgggtaactcccaggagagtgtcacag |
| Ab23 | atcccagagaggccaaagtacagtggaaggtggataacgcccctccaatcgggtaactcccaggagagtgtcacag |
| Ab24 | atcccagagaggccaaagtacagtggaaggtggataacgcccctccaatcgggtaactcccaggagagtgtcacag |
| Ab25 | atcccagagaggccaaagtacagtggaaggtggataacgcccctccaatcgggtaactcccaggagagtgtcacag |
| Ab26 | atcccagagaggccaaagtacagtggaaggtggataacgcccctccaatcgggtaactcccaggagagtgtcacag |
| Ab27 | atcccagagaggccaaagtacagtggaaggtggataacgcccctccaatcgggtaactcccaggagagtgtcacag |
| Ab28 | atcccagagaggccaaagtacagtggaaggtggataacgcccctccaatcgggtaactcccaggagagtgtcacag |

Figure 55H
Antibody Light chain DNA features

| Sequence Name | Constant region |
|---|---|
| Ab1 | agcaggacagcaaggacagcacctacagcctcagcagcaccctgacgctgagcaaagcagactacgagaaacaca |
| Ab2 | agcaggacagcaaggacagcacctacagcctcagcagcaccctgacgctgagcaaagcagactacgagaaacaca |
| Ab3 | agcaggacagcaaggacagcacctacagcctcagcagcaccctgacgctgagcaaagcagactacgagaaacaca |
| Ab4 | agcaggacagcaaggacagcacctacagcctcagcagcaccctgacgctgagcaaagcagactacgagaaacaca |
| Ab5 | agcaggacagcaaggacagcacctacagcctcagcagcaccctgacgctgagcaaagcagactacgagaaacaca |
| Ab6 | agcaggacagcaaggacagcacctacagcctcagcagcaccctgacgctgagcaaagcagactacgagaaacaca |
| Ab7 | agcaggacagcaaggacagcacctacagcctcagcagcaccctgacgctgagcaaagcagactacgagaaacaca |
| Ab8 | agcaggacagcaaggacagcacctacagcctcagcagcaccctgacgctgagcaaagcagactacgagaaacaca |
| Ab9 | agcaggacagcaaggacagcacctacagcctcagcagcaccctgacgctgagcaaagcagactacgagaaacaca |
| Ab10 | agcaggacagcaaggacagcacctacagcctcagcagcaccctgacgctgagcaaagcagactacgagaaacaca |
| Ab11 | agcaggacagcaaggacagcacctacagcctcagcagcaccctgacgctgagcaaagcagactacgagaaacaca |
| Ab12 | agcaggacagcaaggacagcacctacagcctcagcagcaccctgacgctgagcaaagcagactacgagaaacaca |
| Ab13 | agcaggacagcaaggacagcacctacagcctcagcagcaccctgacgctgagcaaagcagactacgagaaacaca |
| Ab14 | agcaggacagcaaggacagcacctacagcctcagcagcaccctgacgctgagcaaagcagactacgagaaacaca |
| Ab15 | agcaggacagcaaggacagcacctacagcctcagcagcaccctgacgctgagcaaagcagactacgagaaacaca |
| Ab16 | agcaggacagcaaggacagcacctacagcctcagcagcaccctgacgctgagcaaagcagactacgagaaacaca |
| Ab17 | agcaggacagcaaggacagcacctacagcctcagcagcaccctgacgctgagcaaagcagactacgagaaacaca |
| Ab18 | agcaggacagcaaggacagcacctacagcctcagcagcaccctgacgctgagcaaagcagactacgagaaacaca |
| Ab19 | agcaggacagcaaggacagcacctacagcctcagcagcaccctgacgctgagcaaagcagactacgagaaacaca |
| Ab20 | agcaggacagcaaggacagcacctacagcctcagcagcaccctgacgctgagcaaagcagactacgagaaacaca |
| Ab21 | agcaggacagcaaggacagcacctacagcctcagcagcaccctgacgctgagcaaagcagactacgagaaacaca |
| Ab23 | agcaggacagcaaggacagcacctacagcctcagcagcaccctgacgctgagcaaagcagactacgagaaacaca |
| Ab24 | agcaggacagcaaggacagcacctacagcctcagcagcaccctgacgctgagcaaagcagactacgagaaacaca |
| Ab25 | agcaggacagcaaggacagcacctacagcctcagcagcaccctgacgctgagcaaagcagactacgagaaacaca |
| Ab26 | agcaggacagcaaggacagcacctacagcctcagcagcaccctgacgctgagcaaagcagactacgagaaacaca |
| Ab27 | agcaggacagcaaggacagcacctacagcctcagcagcaccctgacgctgagcaaagcagactacgagaaacaca |
| Ab28 | agcaggacagcaaggacagcacctacagcctcagcagcaccctgacgctgagcaaagcagactacgagaaacaca |

Figure 55I
Antibody Light chain DNA features

| Sequence Name | Constant region |
|---|---|
| Ab1 | aagtctacgcctgcgaagtcacccatcagggcctgagctcgagctcgcccgtcacaaagagcttcaacacaggggagagtgt |
| Ab2 | aagtctacgcctgcgaagtcacccatcagggcctgagctcgagctcgcccgtcacaaagagcttcaacacaggggagagtgt |
| Ab3 | aagtctacgcctgcgaagtcacccatcagggcctgagctcgagctcgcccgtcacaaagagcttcaacacaggggagagtgt |
| Ab4 | aagtctacgcctgcgaagtcacccatcagggcctgagctcgagctcgcccgtcacaaagagcttcaacacaggggagagtgt |
| Ab5 | aagtctacgcctgcgaagtcacccatcagggcctgagctcgagctcgcccgtcacaaagagcttcaacacaggggagagtgt |
| Ab6 | aagtctacgcctgcgaagtcacccatcagggcctgagctcgagctcgcccgtcacaaagagcttcaacacaggggagagtgt |
| Ab7 | aagtctacgcctgcgaagtcacccatcagggcctgagctcgagctcgcccgtcacaaagagcttcaacacaggggagagtgt |
| Ab8 | aagtctacgcctgcgaagtcacccatcagggcctgagctcgagctcgcccgtcacaaagagcttcaacacaggggagagtgt |
| Ab9 | aagtctacgcctgcgaagtcacccatcagggcctgagctcgagctcgcccgtcacaaagagcttcaacacaggggagagtgt |
| Ab10 | aagtctacgcctgcgaagtcacccatcagggcctgagctcgagctcgcccgtcacaaagagcttcaacacaggggagagtgt |
| Ab11 | aagtctacgcctgcgaagtcacccatcagggcctgagctcgagctcgcccgtcacaaagagcttcaacacaggggagagtgt |
| Ab12 | aagtctacgcctgcgaagtcacccatcagggcctgagctcgagctcgcccgtcacaaagagcttcaacacaggggagagtgt |
| Ab13 | aagtctacgcctgcgaagtcacccatcagggcctgagctcgagctcgcccgtcacaaagagcttcaacacaggggagagtgt |
| Ab14 | aagtctacgcctgcgaagtcacccatcagggcctgagctcgagctcgcccgtcacaaagagcttcaacacaggggagagtgt |
| Ab15 | aagtctacgcctgcgaagtcacccatcagggcctgagctcgagctcgcccgtcacaaagagcttcaacacaggggagagtgt |
| Ab16 | aagtctacgcctgcgaagtcacccatcagggcctgagctcgagctcgcccgtcacaaagagcttcaacacaggggagagtgt |
| Ab17 | aagtctacgcctgcgaagtcacccatcagggcctgagctcgagctcgcccgtcacaaagagcttcaacacaggggagagtgt |
| Ab18 | aagtctacgcctgcgaagtcacccatcagggcctgagctcgagctcgcccgtcacaaagagcttcaacacaggggagagtgt |
| Ab19 | aagtctacgcctgcgaagtcacccatcagggcctgagctcgagctcgcccgtcacaaagagcttcaacacaggggagagtgt |
| Ab20 | aagtctacgcctgcgaagtcacccatcagggcctgagctcgagctcgcccgtcacaaagagcttcaacacaggggagagtgt |
| Ab21 | aagtctacgcctgcgaagtcacccatcagggcctgagctcgagctcgcccgtcacaaagagcttcaacacaggggagagtgt |
| Ab23 | aagtctacgcctgcgaagtcacccatcagggcctgagctcgagctcgcccgtcacaaagagcttcaacacaggggagagtgt |
| Ab24 | aagtctacgcctgcgaagtcacccatcagggcctgagctcgagctcgcccgtcacaaagagcttcaacacaggggagagtgt |
| Ab25 | aagtctacgcctgcgaagtcacccatcagggcctgagctcgagctcgcccgtcacaaagagcttcaacacaggggagagtgt |
| Ab26 | aagtctacgcctgcgaagtcacccatcagggcctgagctcgagctcgcccgtcacaaagagcttcaacacaggggagagtgt |
| Ab27 | aagtctacgcctgcgaagtcacccatcagggcctgagctcgagctcgcccgtcacaaagagcttcaacacaggggagagtgt |
| Ab28 | aagtctacgcctgcgaagtcacccatcagggcctgagctcgagctcgcccgtcacaaagagcttcaacacaggggagagtgt |

Figure 55J
Antibody Light chain DNA features

| Sequence Name | Constant region |
|---|---|
| Ab1 | (SEQ ID NO:31) |
| Ab2 | (SEQ ID NO:71) |
| Ab3 | (SEQ ID NO:111) |
| Ab4 | (SEQ ID NO:151) |
| Ab5 | (SEQ ID NO:191) |
| Ab6 | (SEQ ID NO:231) |
| Ab7 | (SEQ ID NO:271) |
| Ab8 | (SEQ ID NO:311) |
| Ab9 | (SEQ ID NO:351) |
| Ab10 | (SEQ ID NO:391) |
| Ab11 | (SEQ ID NO:431) |
| Ab12 | (SEQ ID NO:471) |
| Ab13 | (SEQ ID NO:511) |
| Ab14 | (SEQ ID NO:551) |
| Ab15 | (SEQ ID NO:591) |
| Ab16 | (SEQ ID NO:631) |
| Ab17 | (SEQ ID NO:671) |
| Ab18 | (SEQ ID NO:711) |
| Ab19 | (SEQ ID NO:751) |
| Ab20 | (SEQ ID NO:791) |
| Ab21 | (SEQ ID NO:831) |
| Ab23 | (SEQ ID NO:871) |
| Ab24 | (SEQ ID NO:911) |
| Ab25 | (SEQ ID NO:951) |
| Ab26 | (SEQ ID NO:991) |
| Ab27 | (SEQ ID NO:1031) |
| Ab28 | (SEQ ID NO:1071) |

Figure 56
Antibody Heavy chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-116 | 2 | 30-34 | 4 | 49-64 | 6 | 95-105 | 8 |
| Ab2 | 1-119 | 42 | 31-35 | 44 | 50-65 | 46 | 98-108 | 48 |
| Ab3 | 1-117 | 82 | 30-34 | 84 | 49-64 | 86 | 95-106 | 88 |
| Ab4 | 1-117 | 122 | 30-34 | 124 | 49-64 | 126 | 95-106 | 128 |
| Ab5 | 1-113 | 162 | 30-34 | 164 | 49-64 | 166 | 95-102 | 168 |
| Ab6 | 1-116 | 202 | 30-34 | 204 | 49-64 | 206 | 95-105 | 208 |
| Ab7 | 1-116 | 242 | 30-34 | 244 | 49-64 | 246 | 95-105 | 248 |
| Ab8 | 1-119 | 282 | 31-35 | 284 | 50-65 | 286 | 98-108 | 288 |
| Ab9 | 1-120 | 322 | 30-34 | 324 | 49-64 | 326 | 96-109 | 328 |
| Ab10 | 1-122 | 362 | 31-35 | 364 | 50-65 | 366 | 98-111 | 368 |
| Ab11 | 1-128 | 402 | 30-34 | 404 | 49-64 | 406 | 95-117 | 408 |
| Ab12 | 1-116 | 442 | 30-34 | 444 | 49-64 | 446 | 95-105 | 448 |
| Ab13 | 1-119 | 482 | 31-35 | 484 | 50-65 | 486 | 98-108 | 488 |
| Ab14 | 1-116 | 522 | 30-34 | 524 | 49-64 | 526 | 95-105 | 528 |
| Ab15 | 1-116 | 562 | 30-34 | 564 | 49-64 | 566 | 95-105 | 568 |
| Ab16 | 1-119 | 602 | 30-34 | 604 | 49-64 | 606 | 95-108 | 608 |
| Ab17 | 1-119 | 642 | 30-34 | 644 | 49-64 | 646 | 95-108 | 648 |
| Ab18 | 1-120 | 682 | 30-34 | 684 | 49-65 | 686 | 96-109 | 688 |
| Ab19 | 1-118 | 722 | 30-34 | 724 | 49-64 | 726 | 95-107 | 728 |
| Ab20 | 1-121 | 762 | 31-35 | 764 | 50-65 | 766 | 98-110 | 768 |
| Ab21 | 1-117 | 802 | 30-34 | 804 | 49-64 | 806 | 95-106 | 808 |
| Ab23 | 1-116 | 842 | 30-34 | 844 | 49-65 | 846 | 96-105 | 848 |
| Ab24 | 1-119 | 882 | 31-35 | 884 | 50-66 | 886 | 99-108 | 888 |
| Ab25 | 1-118 | 922 | 30-34 | 924 | 49-64 | 926 | 95-107 | 928 |
| Ab26 | 1-119 | 962 | 30-34 | 964 | 49-64 | 966 | 95-108 | 968 |
| Ab27 | 1-123 | 1002 | 30-35 | 1004 | 50-67 | 1006 | 99-112 | 1008 |
| Ab28 | 1-119 | 1042 | 31-35 | 1044 | 50-65 | 1046 | 98-108 | 1048 |

Figure 57
Antibody Heavy chain Protein features

| Sequence Name | Constant region coordinates | SEQ ID NO: | FR1 coordinates | SEQ ID NO: | FR2 coordinates | SEQ ID NO: | FR3 coordinates | SEQ ID NO: | FR4 coordinates | SEQ ID NO: |
|---|---|---|---|---|---|---|---|---|---|---|
| Ab1 | 1-29 | 3 | 35-48 | 5 | 65-94 | 7 | 106-116 | 9 | 117-446 | 10 |
| Ab2 | 1-30 | 43 | 36-49 | 45 | 66-97 | 47 | 109-119 | 49 | 120-449 | 50 |
| Ab3 | 1-29 | 83 | 35-48 | 85 | 65-94 | 87 | 107-117 | 89 | 118-447 | 90 |
| Ab4 | 1-29 | 123 | 35-48 | 125 | 65-94 | 127 | 107-117 | 129 | 118-447 | 130 |
| Ab5 | 1-29 | 163 | 35-48 | 165 | 65-94 | 167 | 103-113 | 169 | 114-443 | 170 |
| Ab6 | 1-29 | 203 | 35-48 | 205 | 65-94 | 207 | 106-116 | 209 | 117-446 | 210 |
| Ab7 | 1-29 | 243 | 35-48 | 245 | 65-94 | 247 | 106-116 | 249 | 117-446 | 250 |
| Ab8 | 1-30 | 283 | 36-49 | 285 | 66-97 | 287 | 109-119 | 289 | 120-449 | 290 |
| Ab9 | 1-29 | 323 | 35-48 | 325 | 65-95 | 327 | 110-120 | 329 | 121-450 | 330 |
| Ab10 | 1-30 | 363 | 36-49 | 365 | 66-97 | 367 | 112-122 | 369 | 123-452 | 370 |
| Ab11 | 1-29 | 403 | 35-48 | 405 | 65-94 | 407 | 118-128 | 409 | 129-458 | 410 |
| Ab12 | 1-29 | 443 | 35-48 | 445 | 65-94 | 447 | 106-116 | 449 | 117-446 | 450 |
| Ab13 | 1-30 | 483 | 36-49 | 485 | 66-97 | 487 | 109-119 | 489 | 120-449 | 490 |
| Ab14 | 1-29 | 523 | 35-48 | 525 | 65-94 | 527 | 106-116 | 529 | 117-446 | 530 |
| Ab15 | 1-29 | 563 | 35-48 | 565 | 65-94 | 567 | 106-116 | 569 | 117-446 | 570 |
| Ab16 | 1-29 | 603 | 35-48 | 605 | 65-94 | 607 | 109-119 | 609 | 120-449 | 610 |
| Ab17 | 1-29 | 643 | 35-48 | 645 | 65-94 | 647 | 109-119 | 649 | 120-449 | 650 |
| Ab18 | 1-29 | 683 | 35-48 | 685 | 66-95 | 687 | 110-120 | 689 | 121-450 | 690 |
| Ab19 | 1-29 | 723 | 35-48 | 725 | 65-94 | 727 | 108-118 | 729 | 119-448 | 730 |
| Ab20 | 1-30 | 763 | 36-49 | 765 | 66-97 | 767 | 111-121 | 769 | 122-451 | 770 |
| Ab21 | 1-29 | 803 | 35-48 | 805 | 65-94 | 807 | 107-117 | 809 | 118-447 | 810 |
| Ab22 | 1-29 | 843 | 35-48 | 845 | 66-95 | 847 | 106-116 | 849 | 117-446 | 850 |
| Ab23 | 1-29 | 883 | 35-48 | 885 | 67-98 | 887 | 109-119 | 889 | 120-449 | 890 |
| Ab24 | 1-30 | 923 | 36-49 | 925 | 65-94 | 927 | 108-118 | 929 | 119-448 | 930 |
| Ab25 | 1-29 | 963 | 35-48 | 965 | 65-94 | 967 | 109-119 | 969 | 120-449 | 970 |
| Ab26 | 1-29 | 1003 | 36-49 | 1005 | 68-98 | 1007 | 113-123 | 1009 | 124-453 | 1010 |
| Ab27 | 1-30 | 1043 | 36-49 | 1045 | 66-97 | 1047 | 109-119 | 1049 | 120-449 | 1050 |

Figure 58
Antibody Light chain Protein features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-111 | 22 | 24-34 | 24 | 50-56 | 26 | 89-100 | 28 |
| Ab2 | 1-111 | 62 | 24-34 | 64 | 50-56 | 66 | 89-100 | 68 |
| Ab3 | 1-111 | 102 | 24-34 | 104 | 50-56 | 106 | 89-100 | 108 |
| Ab4 | 1-111 | 142 | 24-34 | 144 | 50-56 | 146 | 89-100 | 148 |
| Ab5 | 1-111 | 182 | 24-34 | 184 | 50-56 | 186 | 89-100 | 188 |
| Ab6 | 1-116 | 222 | 25-35 | 224 | 51-57 | 226 | 90-105 | 228 |
| Ab7 | 1-111 | 262 | 24-34 | 264 | 50-56 | 266 | 89-100 | 268 |
| Ab8 | 1-111 | 302 | 24-34 | 304 | 50-56 | 306 | 89-100 | 308 |
| Ab9 | 1-109 | 342 | 23-34 | 344 | 50-56 | 346 | 89-98 | 348 |
| Ab10 | 1-110 | 382 | 24-35 | 384 | 51-57 | 386 | 90-99 | 388 |
| Ab11 | 1-113 | 422 | 23-35 | 424 | 51-57 | 426 | 90-102 | 428 |
| Ab12 | 1-111 | 462 | 24-34 | 464 | 50-56 | 466 | 89-100 | 468 |
| Ab13 | 1-111 | 502 | 24-34 | 504 | 50-56 | 506 | 89-100 | 508 |
| Ab14 | 1-111 | 542 | 24-34 | 544 | 50-56 | 546 | 89-100 | 548 |
| Ab15 | 1-111 | 582 | 24-34 | 584 | 50-56 | 586 | 89-100 | 588 |
| Ab16 | 1-113 | 622 | 23-35 | 624 | 51-57 | 626 | 90-102 | 628 |
| Ab17 | 1-113 | 662 | 23-35 | 664 | 51-57 | 666 | 90-102 | 668 |
| Ab18 | 1-111 | 702 | 24-34 | 704 | 50-56 | 706 | 89-100 | 708 |
| Ab19 | 1-111 | 742 | 24-34 | 744 | 50-56 | 746 | 89-100 | 748 |
| Ab20 | 1-111 | 782 | 24-34 | 784 | 50-56 | 786 | 89-100 | 788 |
| Ab21 | 1-111 | 822 | 24-34 | 824 | 50-56 | 826 | 89-100 | 828 |
| Ab23 | 1-111 | 862 | 24-34 | 864 | 50-56 | 866 | 89-100 | 868 |
| Ab24 | 1-111 | 902 | 24-34 | 904 | 50-56 | 906 | 89-100 | 908 |
| Ab25 | 1-110 | 942 | 23-35 | 944 | 51-57 | 946 | 90-99 | 948 |
| Ab26 | 1-110 | 982 | 25-35 | 984 | 51-57 | 986 | 90-99 | 988 |
| Ab27 | 1-112 | 1022 | 25-35 | 1024 | 51-57 | 1026 | 90-101 | 1028 |
| Ab28 | 1-111 | 1062 | 24-34 | 1064 | 50-56 | 1066 | 89-100 | 1068 |

Figure 59
Antibody Light chain Protein features

| Sequence Name | Constant region coordinates | FR1 coordinates | SEQ ID NO: | FR2 coordinates | SEQ ID NO: | FR3 coordinates | SEQ ID NO: | FR4 coordinates | SEQ ID NO: |
|---|---|---|---|---|---|---|---|---|---|
| Ab1 | 1-23 | 35-49 | 23 | 57-88 | 25 | 101-111 | 27 | 112-217 | 29 | 30 |
| Ab2 | 1-23 | 35-49 | 63 | 57-88 | 65 | 101-111 | 67 | 112-217 | 69 | 70 |
| Ab3 | 1-23 | 35-49 | 103 | 57-88 | 105 | 101-111 | 107 | 112-217 | 109 | 110 |
| Ab4 | 1-23 | 35-49 | 143 | 57-88 | 145 | 101-111 | 147 | 112-217 | 149 | 150 |
| Ab5 | 1-23 | 35-49 | 183 | 57-88 | 185 | 101-111 | 187 | 112-217 | 189 | 190 |
| Ab6 | 1-24 | 36-50 | 223 | 58-89 | 225 | 106-116 | 227 | 117-222 | 229 | 230 |
| Ab7 | 1-23 | 35-49 | 263 | 57-88 | 265 | 101-111 | 267 | 112-217 | 269 | 270 |
| Ab8 | 1-23 | 35-49 | 303 | 57-88 | 305 | 101-111 | 307 | 112-217 | 309 | 310 |
| Ab9 | 1-22 | 35-49 | 343 | 57-88 | 345 | 99-109 | 347 | 110-215 | 349 | 350 |
| Ab10 | 1-23 | 36-50 | 383 | 58-89 | 385 | 100-110 | 387 | 111-216 | 389 | 390 |
| Ab11 | 1-22 | 36-50 | 423 | 58-89 | 425 | 103-113 | 427 | 114-219 | 429 | 430 |
| Ab12 | 1-23 | 35-49 | 463 | 57-88 | 465 | 101-111 | 467 | 112-217 | 469 | 470 |
| Ab13 | 1-23 | 35-49 | 503 | 57-88 | 505 | 101-111 | 507 | 112-217 | 509 | 510 |
| Ab14 | 1-23 | 35-49 | 543 | 57-88 | 545 | 101-111 | 547 | 112-217 | 549 | 550 |
| Ab15 | 1-23 | 35-49 | 583 | 57-88 | 585 | 101-111 | 587 | 112-217 | 589 | 590 |
| Ab16 | 1-22 | 36-50 | 623 | 58-89 | 625 | 103-113 | 627 | 114-219 | 629 | 630 |
| Ab17 | 1-22 | 36-50 | 663 | 58-89 | 665 | 103-113 | 667 | 114-219 | 669 | 670 |
| Ab18 | 1-23 | 35-49 | 703 | 57-88 | 705 | 101-111 | 707 | 112-217 | 709 | 710 |
| Ab19 | 1-23 | 35-49 | 743 | 57-88 | 745 | 101-111 | 747 | 112-217 | 749 | 750 |
| Ab20 | 1-23 | 35-49 | 783 | 57-88 | 785 | 101-111 | 787 | 112-217 | 789 | 790 |
| Ab21 | 1-23 | 35-49 | 823 | 57-88 | 825 | 101-111 | 827 | 112-217 | 829 | 830 |
| Ab23 | 1-23 | 35-49 | 863 | 57-88 | 865 | 101-111 | 867 | 112-217 | 869 | 870 |
| Ab24 | 1-23 | 35-49 | 903 | 57-88 | 905 | 101-111 | 907 | 112-217 | 909 | 910 |
| Ab25 | 1-22 | 36-50 | 943 | 58-89 | 945 | 100-110 | 947 | 111-216 | 949 | 950 |
| Ab26 | 1-24 | 36-50 | 983 | 58-89 | 985 | 100-110 | 987 | 111-216 | 989 | 990 |
| Ab27 | 1-24 | 36-50 | 1023 | 58-89 | 1025 | 102-112 | 1027 | 113-218 | 1029 | 1030 |
| Ab28 | 1-23 | 35-49 | 1063 | 57-88 | 1065 | 101-111 | 1067 | 112-217 | 1069 | 1070 |

Figure 60
Antibody Heavy chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-348 | 12 | 88-102 | 14 | 145-192 | 16 | 283-315 | 18 |
| Ab2 | 1-357 | 52 | 91-105 | 54 | 148-195 | 56 | 292-324 | 58 |
| Ab3 | 1-351 | 92 | 88-102 | 94 | 145-192 | 96 | 283-318 | 98 |
| Ab4 | 1-351 | 132 | 88-102 | 134 | 145-192 | 136 | 283-318 | 138 |
| Ab5 | 1-339 | 172 | 88-102 | 174 | 145-192 | 176 | 283-306 | 178 |
| Ab6 | 1-348 | 212 | 88-102 | 214 | 145-192 | 216 | 283-315 | 218 |
| Ab7 | 1-348 | 252 | 88-102 | 254 | 145-192 | 256 | 283-315 | 258 |
| Ab8 | 1-357 | 292 | 91-105 | 294 | 145-192 | 296 | 292-324 | 298 |
| Ab9 | 1-360 | 332 | 88-102 | 334 | 148-195 | 336 | 286-327 | 338 |
| Ab10 | 1-366 | 372 | 91-105 | 374 | 148-195 | 376 | 292-333 | 378 |
| Ab11 | 1-384 | 412 | 88-102 | 414 | 145-192 | 416 | 283-351 | 418 |
| Ab12 | 1-348 | 452 | 88-102 | 454 | 145-192 | 456 | 283-315 | 458 |
| Ab13 | 1-357 | 492 | 91-105 | 494 | 148-195 | 496 | 292-324 | 498 |
| Ab14 | 1-348 | 532 | 88-102 | 534 | 145-192 | 536 | 283-315 | 538 |
| Ab15 | 1-348 | 572 | 88-102 | 574 | 145-192 | 576 | 283-315 | 578 |
| Ab16 | 1-357 | 612 | 88-102 | 614 | 145-192 | 616 | 283-324 | 618 |
| Ab17 | 1-357 | 652 | 88-102 | 654 | 145-192 | 656 | 283-324 | 658 |
| Ab18 | 1-360 | 692 | 88-102 | 694 | 145-195 | 696 | 286-327 | 698 |
| Ab19 | 1-354 | 732 | 88-102 | 734 | 145-192 | 736 | 283-321 | 738 |
| Ab20 | 1-363 | 772 | 91-105 | 774 | 148-195 | 776 | 292-330 | 778 |
| Ab21 | 1-351 | 812 | 88-102 | 814 | 145-192 | 816 | 283-318 | 818 |
| Ab23 | 1-348 | 852 | 88-102 | 854 | 145-195 | 856 | 286-315 | 858 |
| Ab24 | 1-357 | 892 | 91-105 | 894 | 148-198 | 896 | 295-324 | 898 |
| Ab25 | 1-354 | 932 | 88-102 | 934 | 145-192 | 936 | 283-321 | 938 |
| Ab26 | 1-357 | 972 | 88-102 | 974 | 145-192 | 976 | 283-324 | 978 |
| Ab27 | 1-369 | 1012 | 88-105 | 1014 | 148-201 | 1016 | 295-336 | 1018 |
| Ab28 | 1-357 | 1052 | 91-105 | 1054 | 148-195 | 1056 | 292-324 | 1058 |

Figure 61
Antibody Heavy chain DNA features

| Sequence Name | Constant region coordinates | SEQ ID NO: | FR1 coordinates | SEQ ID NO: | FR2 coordinates | SEQ ID NO: | FR3 coordinates | SEQ ID NO: | FR4 coordinates | SEQ ID NO: |
|---|---|---|---|---|---|---|---|---|---|---|
| Ab1 | 1-87 | 13 | 103-144 | 15 | 193-282 | 17 | 316-348 | 19 | 349-1338 | 20 |
| Ab2 | 1-90 | 53 | 106-147 | 55 | 196-291 | 57 | 325-357 | 59 | 358-1347 | 60 |
| Ab3 | 1-87 | 93 | 103-144 | 95 | 193-282 | 97 | 319-351 | 99 | 352-1341 | 100 |
| Ab4 | 1-87 | 133 | 103-144 | 135 | 193-282 | 137 | 319-351 | 139 | 352-1341 | 140 |
| Ab5 | 1-87 | 173 | 103-144 | 175 | 193-282 | 177 | 307-339 | 179 | 340-1329 | 180 |
| Ab6 | 1-87 | 213 | 103-144 | 215 | 193-282 | 217 | 316-348 | 219 | 349-1338 | 220 |
| Ab7 | 1-87 | 253 | 103-144 | 255 | 193-282 | 257 | 316-348 | 259 | 349-1338 | 260 |
| Ab8 | 1-90 | 293 | 106-147 | 295 | 196-291 | 297 | 325-357 | 299 | 358-1347 | 300 |
| Ab9 | 1-87 | 333 | 103-144 | 335 | 193-285 | 337 | 328-360 | 339 | 361-1350 | 340 |
| Ab10 | 1-90 | 373 | 106-147 | 375 | 196-291 | 377 | 334-366 | 379 | 367-1356 | 380 |
| Ab11 | 1-87 | 413 | 103-144 | 415 | 193-282 | 417 | 352-384 | 419 | 385-1374 | 420 |
| Ab12 | 1-87 | 453 | 103-144 | 455 | 193-282 | 457 | 316-348 | 459 | 349-1338 | 460 |
| Ab13 | 1-90 | 493 | 106-147 | 495 | 196-291 | 497 | 325-357 | 499 | 358-1347 | 500 |
| Ab14 | 1-87 | 533 | 103-144 | 535 | 193-282 | 537 | 316-348 | 539 | 349-1338 | 540 |
| Ab15 | 1-87 | 573 | 103-144 | 575 | 193-282 | 577 | 316-348 | 579 | 349-1338 | 580 |
| Ab16 | 1-87 | 613 | 103-144 | 615 | 193-282 | 617 | 325-357 | 619 | 358-1347 | 620 |
| Ab17 | 1-87 | 653 | 103-144 | 655 | 193-285 | 657 | 325-357 | 659 | 358-1347 | 660 |
| Ab18 | 1-87 | 693 | 103-144 | 695 | 196-285 | 697 | 328-360 | 699 | 361-1350 | 700 |
| Ab19 | 1-87 | 733 | 103-144 | 735 | 193-282 | 737 | 322-354 | 739 | 355-1344 | 740 |
| Ab20 | 1-90 | 773 | 106-147 | 775 | 196-291 | 777 | 331-363 | 779 | 364-1353 | 780 |
| Ab21 | 1-87 | 813 | 103-144 | 815 | 193-282 | 817 | 319-351 | 819 | 352-1341 | 820 |
| Ab23 | 1-87 | 853 | 103-144 | 855 | 196-285 | 857 | 316-348 | 859 | 349-1338 | 860 |
| Ab24 | 1-90 | 893 | 106-147 | 895 | 199-294 | 897 | 325-357 | 899 | 358-1347 | 900 |
| Ab25 | 1-87 | 933 | 103-144 | 935 | 193-282 | 937 | 322-354 | 939 | 355-1344 | 940 |
| Ab26 | 1-87 | 973 | 103-144 | 975 | 193-282 | 977 | 325-357 | 979 | 358-1347 | 980 |
| Ab27 | 1-87 | 1013 | 106-147 | 1015 | 202-294 | 1017 | 337-369 | 1019 | 370-1359 | 1020 |
| Ab28 | 1-90 | 1053 | 106-147 | 1055 | 196-291 | 1057 | 325-357 | 1059 | 358-1347 | 1060 |

Figure 62
Antibody Light chain DNA features

| Sequence Name | Variable region coordinates | SEQ ID NO: | CDR1 coordinates | SEQ ID NO: | CDR2 coordinates | SEQ ID NO: | CDR3 coordinates | SEQ ID NO: |
|---|---|---|---|---|---|---|---|---|
| Ab1 | 1-333 | 32 | 70-102 | 34 | 148-168 | 36 | 265-300 | 38 |
| Ab2 | 1-333 | 72 | 70-102 | 74 | 148-168 | 76 | 265-300 | 78 |
| Ab3 | 1-333 | 112 | 70-102 | 114 | 148-168 | 116 | 265-300 | 118 |
| Ab4 | 1-333 | 152 | 70-102 | 154 | 148-168 | 156 | 265-300 | 158 |
| Ab5 | 1-333 | 192 | 70-102 | 194 | 148-168 | 196 | 265-300 | 198 |
| Ab6 | 1-348 | 232 | 73-105 | 234 | 151-171 | 236 | 268-315 | 238 |
| Ab7 | 1-333 | 272 | 70-102 | 274 | 148-168 | 276 | 265-300 | 278 |
| Ab8 | 1-333 | 312 | 70-102 | 314 | 148-168 | 316 | 265-300 | 318 |
| Ab9 | 1-327 | 352 | 67-102 | 354 | 148-168 | 356 | 265-294 | 358 |
| Ab10 | 1-330 | 392 | 70-105 | 394 | 151-171 | 396 | 268-297 | 398 |
| Ab11 | 1-339 | 432 | 67-105 | 434 | 151-171 | 436 | 268-306 | 438 |
| Ab12 | 1-333 | 472 | 70-102 | 474 | 148-168 | 476 | 265-300 | 478 |
| Ab13 | 1-333 | 512 | 70-102 | 514 | 148-168 | 516 | 265-300 | 518 |
| Ab14 | 1-333 | 552 | 70-102 | 554 | 148-168 | 556 | 265-300 | 558 |
| Ab15 | 1-333 | 592 | 70-102 | 594 | 148-168 | 596 | 265-300 | 598 |
| Ab16 | 1-339 | 632 | 67-105 | 634 | 148-168 | 636 | 268-306 | 638 |
| Ab17 | 1-339 | 672 | 67-105 | 674 | 151-171 | 676 | 268-306 | 678 |
| Ab18 | 1-333 | 712 | 70-102 | 714 | 148-168 | 716 | 265-300 | 718 |
| Ab19 | 1-333 | 752 | 70-102 | 754 | 148-168 | 756 | 265-300 | 758 |
| Ab20 | 1-333 | 792 | 70-102 | 794 | 148-168 | 796 | 265-300 | 798 |
| Ab21 | 1-333 | 832 | 70-102 | 834 | 148-168 | 836 | 265-300 | 838 |
| Ab23 | 1-333 | 872 | 70-102 | 874 | 148-168 | 876 | 265-300 | 878 |
| Ab24 | 1-333 | 912 | 70-102 | 914 | 148-168 | 916 | 265-300 | 918 |
| Ab25 | 1-330 | 952 | 67-105 | 954 | 151-171 | 956 | 265-300 | 958 |
| Ab26 | 1-330 | 992 | 73-105 | 994 | 151-171 | 996 | 268-297 | 998 |
| Ab27 | 1-336 | 1032 | 73-105 | 1034 | 151-171 | 1036 | 268-303 | 1038 |
| Ab28 | 1-333 | 1072 | 70-102 | 1074 | 148-168 | 1076 | 265-300 | 1078 |

Figure 63
Antibody Light chain DNA features

| Sequence Name | Constant region coordinates | SEQ ID NO: | FR1 coordinates | SEQ ID NO: | FR2 coordinates | SEQ ID NO: | FR3 coordinates | SEQ ID NO: | FR4 coordinates | SEQ ID NO: |
|---|---|---|---|---|---|---|---|---|---|---|
| Ab1 | 1-69 | 33 | 103-147 | 35 | 169-264 | 37 | 301-333 | 39 | 334-651 | 40 |
| Ab2 | 1-69 | 73 | 103-147 | 75 | 169-264 | 77 | 301-333 | 79 | 334-651 | 80 |
| Ab3 | 1-69 | 113 | 103-147 | 115 | 169-264 | 117 | 301-333 | 119 | 334-651 | 120 |
| Ab4 | 1-69 | 153 | 103-147 | 155 | 169-264 | 157 | 301-333 | 159 | 334-651 | 160 |
| Ab5 | 1-69 | 193 | 103-147 | 195 | 169-264 | 197 | 301-333 | 199 | 334-651 | 200 |
| Ab6 | 1-72 | 233 | 106-150 | 235 | 172-267 | 237 | 316-348 | 239 | 349-666 | 240 |
| Ab7 | 1-69 | 273 | 103-147 | 275 | 169-264 | 277 | 301-333 | 279 | 334-651 | 280 |
| Ab8 | 1-69 | 313 | 103-147 | 315 | 169-264 | 317 | 301-333 | 319 | 334-651 | 320 |
| Ab9 | 1-66 | 353 | 103-147 | 355 | 169-264 | 357 | 295-327 | 359 | 328-645 | 360 |
| Ab10 | 1-69 | 393 | 106-150 | 395 | 172-267 | 397 | 298-330 | 399 | 331-648 | 400 |
| Ab11 | 1-66 | 433 | 106-150 | 435 | 172-267 | 437 | 307-339 | 439 | 340-657 | 440 |
| Ab12 | 1-69 | 473 | 103-147 | 475 | 169-264 | 477 | 301-333 | 479 | 334-651 | 480 |
| Ab13 | 1-69 | 513 | 103-147 | 515 | 169-264 | 517 | 301-333 | 519 | 334-651 | 520 |
| Ab14 | 1-69 | 553 | 103-147 | 555 | 169-264 | 557 | 301-333 | 559 | 334-651 | 560 |
| Ab15 | 1-69 | 593 | 103-147 | 595 | 169-264 | 597 | 301-333 | 599 | 334-651 | 600 |
| Ab16 | 1-66 | 633 | 106-150 | 635 | 169-264 | 637 | 301-333 | 639 | 340-657 | 640 |
| Ab17 | 1-66 | 673 | 106-150 | 675 | 172-267 | 677 | 307-339 | 679 | 340-657 | 680 |
| Ab18 | 1-69 | 713 | 103-147 | 715 | 169-264 | 717 | 301-333 | 719 | 334-651 | 720 |
| Ab19 | 1-69 | 753 | 103-147 | 755 | 169-264 | 757 | 301-333 | 759 | 334-651 | 760 |
| Ab20 | 1-69 | 793 | 103-147 | 795 | 169-264 | 797 | 301-333 | 799 | 334-651 | 800 |
| Ab21 | 1-69 | 833 | 103-147 | 835 | 169-264 | 837 | 301-333 | 839 | 334-651 | 840 |
| Ab23 | 1-69 | 873 | 103-147 | 875 | 169-264 | 877 | 301-333 | 879 | 334-651 | 880 |
| Ab24 | 1-69 | 913 | 103-147 | 915 | 169-264 | 917 | 301-333 | 919 | 334-651 | 920 |
| Ab25 | 1-66 | 953 | 106-150 | 955 | 169-264 | 957 | 298-330 | 959 | 331-648 | 960 |
| Ab26 | 1-72 | 993 | 106-150 | 995 | 172-267 | 997 | 298-330 | 999 | 331-648 | 1000 |
| Ab27 | 1-72 | 1033 | 106-150 | 1035 | 172-267 | 1037 | 304-336 | 1039 | 337-654 | 1040 |
| Ab28 | 1-69 | 1073 | 103-147 | 1075 | 169-264 | 1077 | 301-333 | 1079 | 334-651 | 1080 |

ANTIBODIES TO HGF AND COMPOSITIONS CONTAINING

PRIORITY APPLICATION INFORMATION

This application claims priority to U.S. Provisional Application No. 61/782,868, filed Mar. 14, 2013, which is hereby incorporated by reference in its entirety herein.

This application includes as part of its disclosure a biological sequence listing which is being concurrently submitted through EFS-Web. Said biological sequence listing is contained in a file named "678580970000.txt" which was created on Mar. 14, 2013 and has a size of 645,676 bytes, and is hereby incorporated by reference in its entirety.

BACKGROUND OF THE INVENTION

1. Field of the Invention

This invention pertains to antibodies and fragments thereof, preferably high affinity or avidity antibodies having binding specificity to Hepatocyte Growth Factor (hereinafter "HGF"). The invention also pertains to methods of screening for diseases and disorders associated with HGF, and methods of preventing or treating diseases and disorders associated with HGF by administering said antibodies or fragments thereof.

2. Description of Related Art

Hepatocyte Growth Factor (HGF) (also known as scatter factor (SF) is produced as a single-chain inactive precursor that is cleaved by serine proteases into two chains that are linked by a disulfide bond. (Abounader, R., et al., Neuro-Oncology, 7:436-451 (2005)) The gene encoding HGF is located on chromosome 7q21.1. The biologically active form of HGF is a heterodimer composed of a 69-kDa α-chain and a 34-kDa β-chain. The α-chain contains an N-terminal hairpin domain and 4 kringle domains, while the β-chain contains a serine protease-like domain having no enzymatic activity. Id.

Human Hepatocyte Growth Factor (HGF) is a multifunctional heterodimeric polypeptide produced by mesenchymal cells. HGF has been shown to stimulate angiogenesis, morphogenesis and motogenesis, as well as the growth and scattering of various cell types (Bussolino et al., J. Cell. Biol. 119: 629, 1992; Zarnegar and Michalopoulos, J. Cell. Biol. 129:1177, 1995; Matsumoto et al, Ciba. Found. Symp. 212:198, 1997; Birchmeier and Gherardi, Trends Cell. Biol. 8:404, 1998; Xin et al., Am. J. pathol. 158:1111, 2001). The pleiotropic activities of HGF are mediated through its receptor, a transmembrane tyrosine kinase encoded by the proto-oncogene c-met. In addition to regulating a variety of normal cellular functions, HGF and its receptor c-met have been shown to be involved in the initiation, invasion and metastasis of tumors (Jeffers et al., J. Mol. Med. 74:505, 1996; Comoglio and Trusolino, J. Clin. Invest. 109:857, 2002). HGF/c-met are coexpressed, often over-expressed, on various human solid tumors including tumors derived from lung, colon, rectum, stomach, kidney, ovary, skin, multiple myeloma and thyroid tissue (Prat et al., Int. J. Cancer 49:323, 1991; Chan et al., Oncogene 2:593, 1988; Weidner et al., Am. J. Respir. Cell Mol. Biol, 8:229, 1993; Derksen et al., Blood 99:1405, 2002). HGF acts as an autocrine (Rong et al., Proc. Natl. Acad. Sci. USA 91:4731, 1994; Koochekpour et al., Cancer Res. 57:5391, 1997) and paracrine growth factor (Weidner et al., Am. J. Respir. Cell Mol. Biol. 8:229, 1993) and anti-apoptotic regulator (Gao et al., J. Biol. Chem. 276:47257, 2001) for these tumors.

HGF is a 102 kDa protein with sequence and structural similarity to plasminogen and other enzymes of blood coagulation (Nakamura et al., Nature 342:440, 1989; Weidner et al., Am. J. Respir. Cell. Mol. Biol. 8:229, 1993, each of which is incorporated herein by reference). Human HGF is synthesized as a 728 amino acid precursor (pre-proHGF), which undergoes intracellular cleavage to an inactive, single chain form (proHGF) (Nakamura et al., Nature 342:440, 1989: Rosen et al., J. Cell. Biol. 127:1783, 1994). Upon extracellular secretion, proHGF is cleaved to yield the biologically active disulfide-linked heterodimeric molecule composed of an alpha-subunit and beta-subunit. (Nakamura et al., Nature 342:440, 1989; Naldini et al., EMBO J. 11:4825, 1992) The alpha-subunit contains 440 residues (69 kDa with glycosylation), consisting of the N-terminal hairpin domain and four kringle domains. The beta-subunit contains 234 residues (34 kDa) and has a serine protease-like domain, which lacks proteolytic activity. Cleavage of HGF is required for receptor activation, but not for receptor binding (Hartmann et al., Proc. Natl. Acad. Sci. USA 89:11574, 1992; Lokker et al., J. Biol. Chem. 288: 17145, 1992). HGF contains 4 putative N-glycosylation sites, 1 in the alpha-subunit and 3 in the beta-subunit. HGF has 2 unique cell specific binding sites: a high affinity ($Kd=2\times10^{-10}$ M) binding site for the c-met receptor and a low affinity ($Kd=10^{-9}$ M) binding site for heparin sulfate proteoglycans (HSPG), which are present on the cell surface and extracellular matrix (Naldinl et al., Oncogene 6:501, 1991; Bardelii et al., J. Biotechnol. 37:109, 1994; Sakata et al., J. Biol. Chem., 272:9457, 1997).

c-met is a member of the class IV protein tyrosine kinase receptor family. The full length c-met gene was cloned and identified as the c-met proto-oncogene (Cooper et al., Nature 311:29, 1984; Park et al., Proc. Natl. Acad. Sci. USA 84:6379, 1987). The c-met receptor is initially synthesized as a single chain, partially glycosylated precursor, $p170_{(MET)}$ (Park et al., Proc. Natl. Acad. Sci. USA 84:6379, 1987; Giordano et al., Nature 339:155, 1989; Giordano et al., Oncogene 4:1383, 1989; Bardelli et al., J. Biotechnol. 37:109, 1994). Upon further glycosylation, the protein is proteolytically cleaved into a heterodimeric 190 kDa mature protein (1385 amino acids), consisting of the 50 kDa alpha-subunit (residues 1-307) and the 145 kDa beta-subunit. The cytoplasmic tyrosine kinase domain of the beta-subunit is involved in signal transduction.

Several different approaches have been investigated to obtain HGF inhibitors or HGF antagonists. Such inhibitors include truncated HGF proteins such as NK1 (N terminal domain plus kringle domain 1: Lokker et al., J. Biol. Chem. 268:17145, 1993); NK2 (N terminal domain plus kringle domains 1 and 2: Chan et al., Science 254:1382, 1991); and NK4 (N-terminal domain plus four kringle domains), which was shown to partially inhibit the primary growth and metastasis of murine lung tumor LLC in a nude mouse model (Kuba et al., Cancer Res. 60:6737, 2000).

As another approach, Dodge (Master's Thesis, San Francisco State University, 1998) generated antagonist anti-c-met monoclonal antibodies (mAbs). One mAb, 5D5, exhibited strong antagonistic activity in ELISA, but induced a proliferative response of c-met-expressing BAF-3 cells, presumably due to dimerization of the membrane receptors. For this reason, a single domain form of the anti-c-met mAb 5D5 has been developed as an antagonist (Nguyen et al., Cancer Gene Ther, 10:840, 2003).

Cao et al., Proc. Natl. Acad. Sci. USA 98:7443, 2001, reported that the administration of a cocktail of three anti-HGF mAbs, which were selected based upon their ability to inhibit the scattering activity of HGF in vitro, were able to inhibit the growth of human tumors in the xenograft nude mouse model.

More recently, neutralizing (inhibitory) anti-HGF mAbs have been reported including L2G7 (Kim et al., Clin Cancer Res 12:1292, 2006, WO 2005/107800, and U.S. Pat. No. 7,220,410 HuL2G7 (WO 2007/115049, the human mAbs described in WO 2005/17107, and the HGF binding proteins described in WO 2007/143090 or WO 2007/143098. It has also been reported that the anti-HGF mAb L2G7, when administered systemically, can strongly inhibit growth or even induce regression of orthotopic (intracranial) glioma xenografts and prolong animal survival (Kim et al., op. cit and WO 2006/130773).

As disclosed herein, HGF promotes the growth and/or scattering of various cell types, and has been shown to be involved in the promotion of angiogenesis, the inhibition of cell growth, and the conversion from a mesenchymal to an epithelial phenotype. Also, both HGF and c-met are expressed in a wide variety of human tumors, and their expression levels is sometimes correlated with poor prognosis. Moreover HGF is believed to play a role in the development of a multitude of diseases and disorders, including but not limited to the development and metastasis of numerous cancers, and the development of macular degeneration. Due to the perceived involvement of HGF in a wide range of diseases and disorders, there remains a need in the art for HGF antagonists and compositions containing and methods useful for preventing or treating diseases associated with HGF, as well as methods of screening to identify patients having diseases or disorders associated with HGF. Particularly preferred are anti-HGF antagonists and compositions containing which effectively inhibit at least one HGF associated biological activity and which elicit minimal or no adverse reactions when administered to a patient. The present invention achieves this objective.

BRIEF SUMMARY OF THE INVENTION

The present invention is directed to specific antibodies and fragments thereof having binding specificity for HGF, in particular antibodies having desired epitopic specificity, high affinity or avidity and/or functional properties. One embodiment of the invention encompasses chimeric or humanized antibodies and fragments thereof capable of binding to HGF and/or the HGF-HGFR complex. Another embodiment of this invention relates to the antibodies described herein, comprising the sequences of the $V_H$, $V_L$ and CDR polypeptides described herein, and the polynucleotides encoding them. In more specific embodiments of the invention these antibodies will possess binding affinities (Kd's) less than 500 picomolar and/or $K_{off}$ values less than or equal to $10^{-4}$ $S^{-1}$.

More particularly, the invention provides rabbit antibodies and humanized and chimeric antibodies derived therefrom specific to HGF as well as antibody fragments specific to HGF which include e.g., Fab', F(ab')$_2$, Fv, scFv fragments, SMIPs (small molecule immunopharmaceuticals), camelbodies, nanobodies, monovalent antibodies such as MetMab like antibodies, and IgNAR which may be used in therapy and diagnostics.

Further, the invention provides nucleic acids and host cells containing that encode for and result in the expression of the subject anti-HGF antibodies, i.e., rabbit antibodies and antibody fragments and modified forms thereof including, by way of example, humanized and chimeric antibodies derived therefrom as well as antibody fragments which include e.g., Fab', F(ab')$_2$, Fv, scFv fragments, SMIPs (small molecule immunopharmaceuticals), camelbodies, nanobodies, monovalent antibodies such as MetMab like antibodies, and IgNAR.

Also the invention relates to expression systems for the manufacture of the inventive anti-HGF antibodies, including yeast, fungi, mammalian, and other cells useful for the manufacture of antibodies and antibody fragments.

Also, the invention relates to novel antibodies and antibody fragments that specifically bind to human HGF which compete with and/or specifically bind to the same or overlapping epitope(s) on HGF as any of the anti-HGF antibodies and antibody fragments exemplified herein.

Further, the invention provides anti-HGF antibodies and antibody fragments that partially or fully neutralize HGF, and which partially or completely inhibit one or more biological activities of HGF such as the ability of HGF to cause fibrosis or the scattering, proliferation, angiogenesis, or chemotaxis of cells.

The invention further pertains to the in vivo use of the subject anti-HGF antibodies and antibody fragments alone or in association with other active agents or drugs for blocking, inhibiting or neutralizing HGF or at least one activity of HGF and/or for inhibiting or blocking the HGF/HGF-R (c-met) interaction or inhibiting c-met activation.

The invention further specifically pertains to the in vivo use of the subject anti-HGF antibodies and antibody fragments alone or in association with other active agents or drugs.

The invention further specifically pertains to the, anti-HGF antibodies described herein, or fragments thereof, for ameliorating or reducing the symptoms of, or treating, or preventing, the following non-limiting listing of proliferative, non-proliferative diseases and disorders such as cancers, including ovarian cancer, breast cancer, lung cancer (small cell or non-small cell), colon and colorectal cancer, prostate cancer, pancreatic cancer, renal cancer, gastric cancer, liver cancer, bladder cancer, thyroid cancer, endometrial cancer, head-and-neck tumors, melanoma, sarcomas, leukemias; lymphomas; and brain tumors (e.g., glioblastomas), of children or adults; macular degeneration; Alzheimer's disease; and malarial infection. In a preferred embodiment, the disease is selected from a cancer or macular degeneration.

The invention further pertains to medicaments for the therapeutic and/or prophylactic treatment of different diseases such as a cancer, a tumor, a cell proliferative disorder, an immune (such as autoimmune) disorder and/or an angiogenesis-related disorder. In another embodiment, the invention provides use of a nucleic acid of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder.

The invention further pertains to the use of an expression vector of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder. In another embodiment of the invention, the invention provides use of an of a host cell of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder. In another embodiment of the invention, the invention provides the use of an article of manufacture of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder. The invention further pertains to the use of a kit of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder.

The invention further specifically pertains to modulating disease states associated with dysregulation of the HGF/c-met signaling axis and thereby modulating at least one of cell proliferation, invasion, metastasis and angiogenesis.

Methods of the invention can be used to affect any pathological state associated with dysregulation of the HGF/c-met signaling which includes chronic and acute disorders or diseases including those pathological conditions which predispose the mammal to the disorder in question. Non-limiting examples of disorders to be treated herein include malignant and benign tumors; non-leukemias and lymphoid malignancies; neuronal, glial, astrocytal, hypothalamic and other glandular, macrophagal, epithelial, stromal and blastocoelic disorders; and inflammatory, immunologic and other angiogenesis-related disorders. carcinoma, lymphoma, blastoma, sarcoma, and leukemia. More particular examples of such cancers include squamous cell cancer, small-cell lung cancer, non-small cell lung cancer, adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, liver cancer, prostate cancer, vulval cancer, thyroid cancer, hepatic carcinoma and various types of head and neck cancer; disorders involving dysregulation of angiogenesis including both non-neoplastic and neoplastic conditions such as the cancers described herein and non-neoplastic disorders including but are not limited to undesired or aberrant hypertrophy, arthritis, rheumatoid arthritis (RA), psoriasis, psoriatic plaques, sarcoidosis, atherosclerosis, atherosclerotic plaques, diabetic and other proliferative retinopathies including retinopathy of prematurity, retrolental fibroplasia, neovascular glaucoma, age-related macular degeneration, diabetic macular edema, corneal neovascularization, corneal graft neovascularization, corneal graft rejection, retinal/choroidal neovascularization, neovascularization of the angle (rubeosis), ocular neovascular disease, vascular restenosis, arteriovenous malformations (AVM), meningioma, hemangioma, angiofibroma, thyroid hyperplasias (including Grave's disease), corneal and other tissue transplantation, chronic inflammation, lung inflammation, acute lung injury/ARDS, sepsis, primary pulmonary hypertension, malignant pulmonary effusions, cerebral edema (e.g., associated with acute stroke/closed head injury/trauma), synovial inflammation, pannus formation in RA, myositis ossificans, hypertropic bone formation, osteoarthritis (OA), refractory ascites, polycystic ovarian disease, endometriosis, 3rd spacing of fluid diseases (pancreatitis, compartment syndrome, burns, bowel disease), uterine fibroids, premature labor, chronic inflammation such as IBD (Crohn's disease and ulcerative colitis), renal allograft rejection, inflammatory bowel disease, nephrotic syndrome, undesired or aberrant tissue mass growth (non-cancer), hemophilic joints, hypertrophic scars, inhibition of hair growth, Osler-Weber syndrome, pyogenic granuloma retrolental fibroplasias, scleroderma, trachoma, vascular adhesions, synovitis, dermatitis, preeclampsia, ascites, pericardial effusion (such as that associated with pericarditis), and pleural effusion.

In certain embodiments, a specific binding agent to HGF is used with one or more particular therapeutic agents to treat various cancers. In certain embodiments, a specific binding agent to HGF is used with one or more particular therapeutic agents to treat or prevent malaria. In certain embodiments, a specific binding agent to HGF is used with one or more particular therapeutic agents to treat or prevent proliferative diabetic retinopathy. In certain embodiments, in view of the condition and the desired level of treatment, two, three, or more agents may be administered. In certain embodiments, such agents may be provided together by inclusion in the same formulation. In certain embodiments, such agents and a specific binding agent to HGF may be provided together by inclusion in the same formulation. In certain embodiments, such agents may be formulated separately and provided together by inclusion in a treatment kit. In certain embodiments, such agents and a specific binding agent to HGF may be formulated separately and provided together by inclusion in a treatment kit. In certain embodiments, such agents may be provided separately.

The invention also contemplates conjugates of anti-HGF antibodies and binding fragments thereof conjugated to one or more functional or detectable moieties. The invention also contemplates methods of making said chimeric or humanized anti-HGF or anti-HGF/HGFR complex antibodies and binding fragments thereof. In one embodiment, binding fragments include, but are not limited to, Fab, Fab', F(ab')$_2$, Fv, scFv fragments, SMIPs (small molecule immunopharmaceuticals), camelbodies, nanobodies, and IgNAR.

Embodiments of the invention pertain to the use of anti-HGF antibodies for the diagnosis, assessment and treatment of diseases and disorders associated with HGF or aberrant expression thereof. The invention also contemplates the use of fragments of anti-HGF antibodies for the diagnosis, assessment and treatment of diseases and disorders associated with HGF or aberrant expression thereof. Other embodiments of the invention relate to the production of anti-HGF antibodies in recombinant host cells, preferably diploid yeast such as diploid *Pichia* and other yeast strains.

BRIEF DESCRIPTION OF THE SEVERAL VIEWS OF THE DRAWINGS

FIGS. 52A-52G provide the polypeptide sequences of the full-length heavy chain for antibodies Ab1-Ab21, and Ab23-28 aligned by their framework regions (FR), complementarity determining regions (CDRs), and constant regions.

FIGS. 53A-53D provide the polypeptide sequences of the full-length light chain for antibodies Ab1-Ab21 and Ab23-28 aligned by their framework regions (FR), complementarity determining regions (CDRs), and constant regions.

FIG. 54A-54S provide the polynucleotide sequences encoding the full-length heavy chain for antibodies Ab1-

Figure 1:
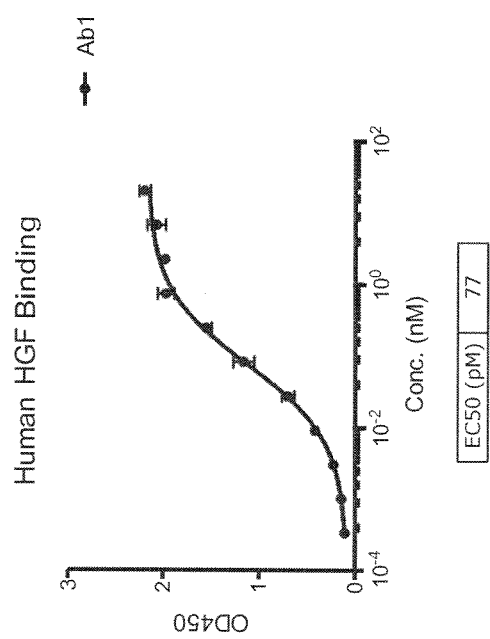
FIG. 1 provides the human-HGF ELISA binding data obtained following the protocol in Example 8 infra for antibody Ab1.
Figure 2:
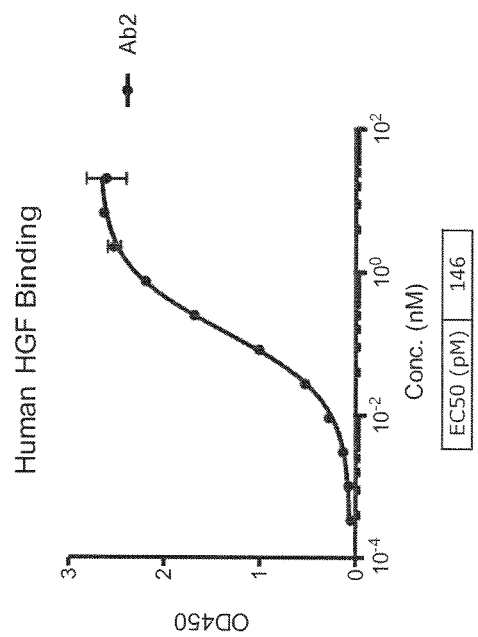
FIG. 2 provides the human-HGF ELISA binding data obtained following the protocol in Example 8 infra for antibody Ab2.
Figure 3:
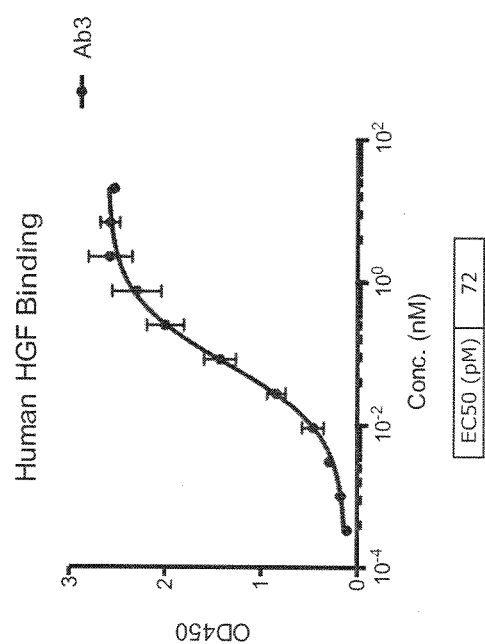
FIG. 3 provides the human-HGF ELISA binding data obtained following the protocol in Example 8 infra for antibody Ab3.
Figure 4:
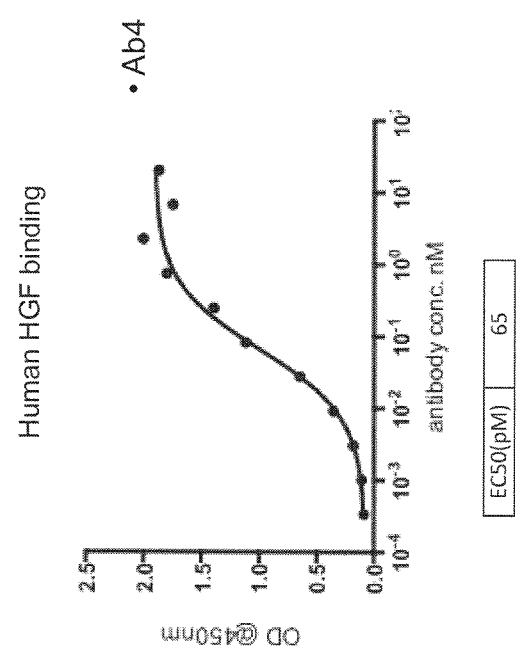
FIG. 4 provides the human-HGF ELISA binding data obtained following the protocol in Example 7 infra for antibody Ab4.
Figure 5:
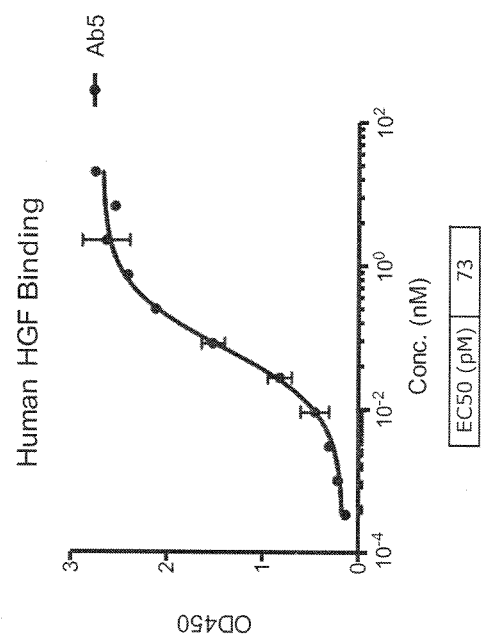
FIG. 5 provides the human-HGF ELISA binding data obtained following the protocol in Example 8 infra for antibody Ab5.
Figure 6:
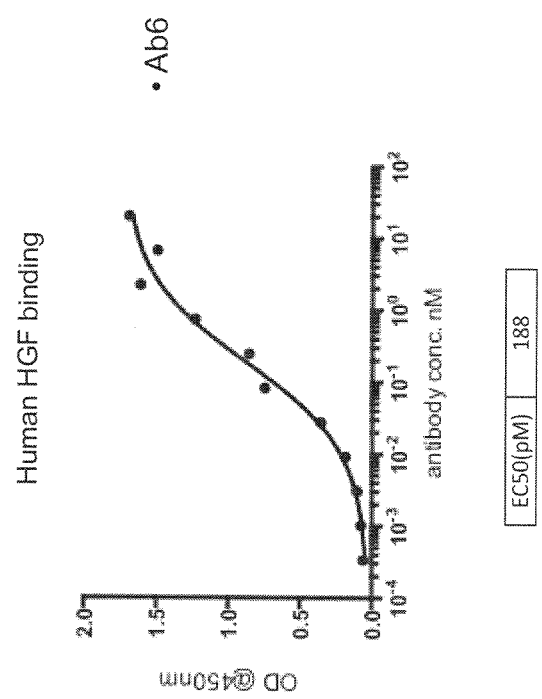
FIG. 6 provides the human-HGF ELISA binding data obtained following the protocol in Example 8 infra for antibody Ab6.
Figure 7:
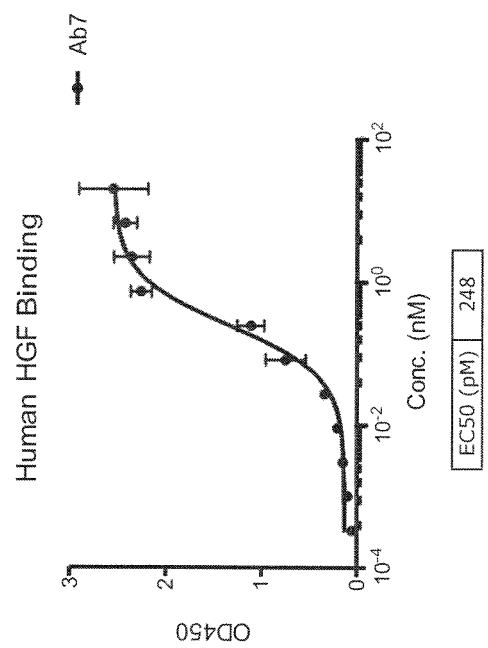
FIG. 7 provides the human-HGF ELISA binding data obtained following the protocol in infra for antibody Ab7.
Figure 8:
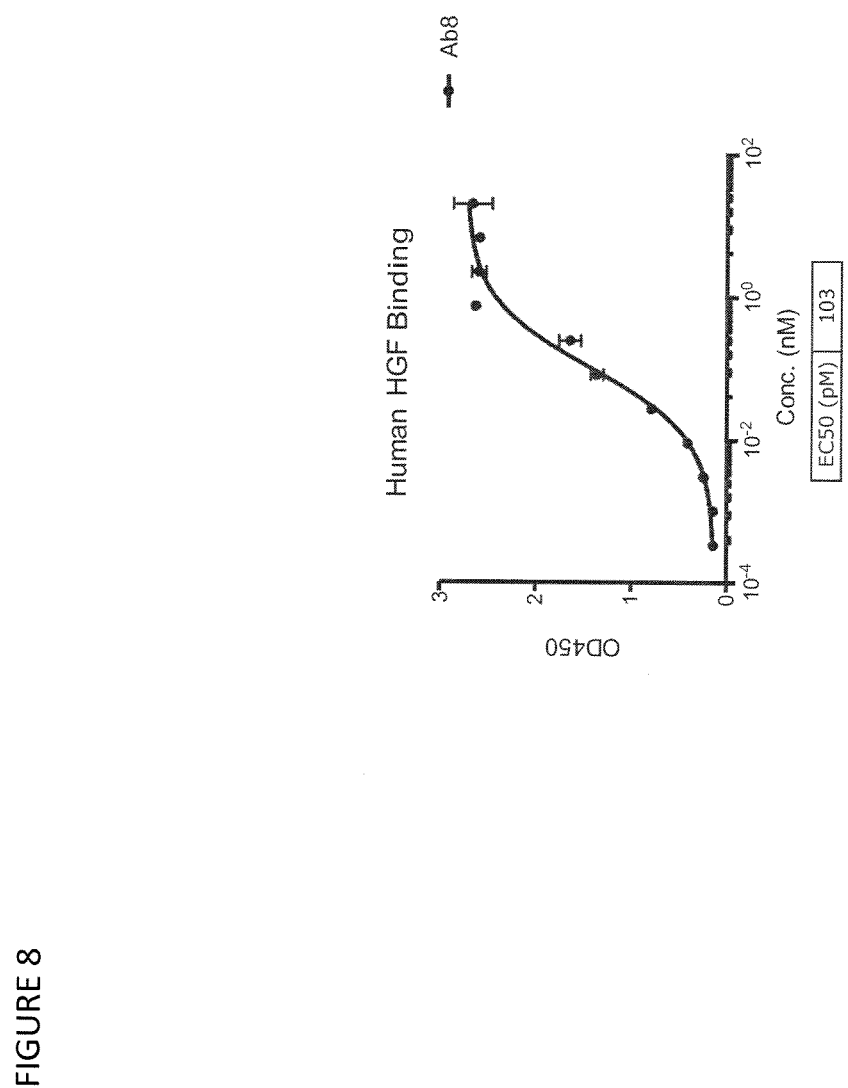
FIG. 8 provides the human-HGF ELISA binding data obtained following the protocol in Example 8 infra for antibody Ab8.
Figure 9:
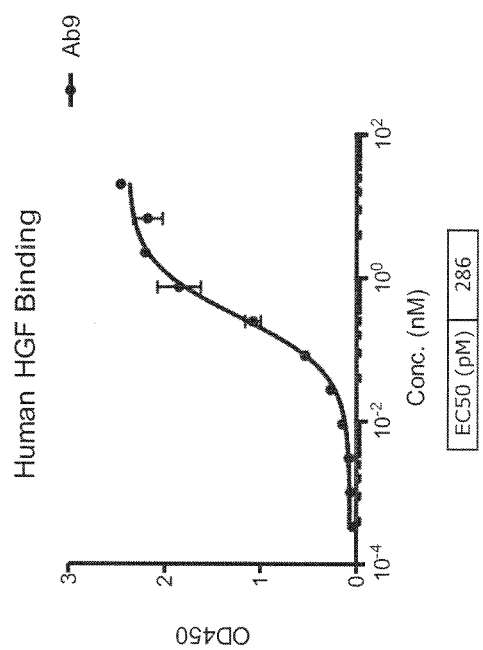
FIG. 9 provides the human-HGF ELISA binding data obtained following the protocol in Example 8 infra for antibody Ab9.
Figure 10:
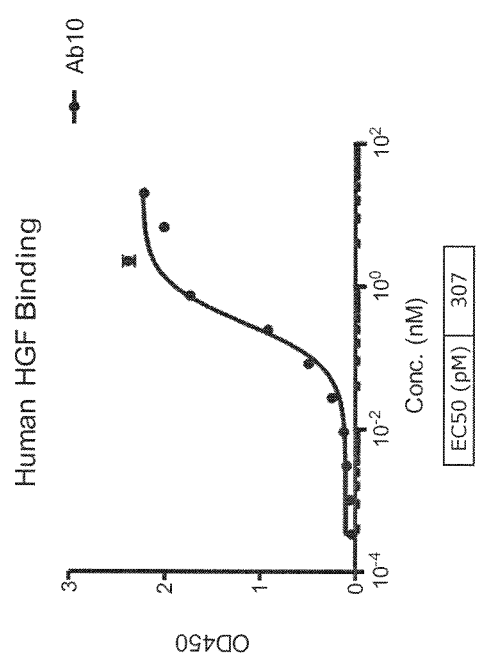
FIG. 10 provides the human-HGF ELISA binding data obtained following the protocol in Example 8 infra for antibody Ab10.
Figure 11:
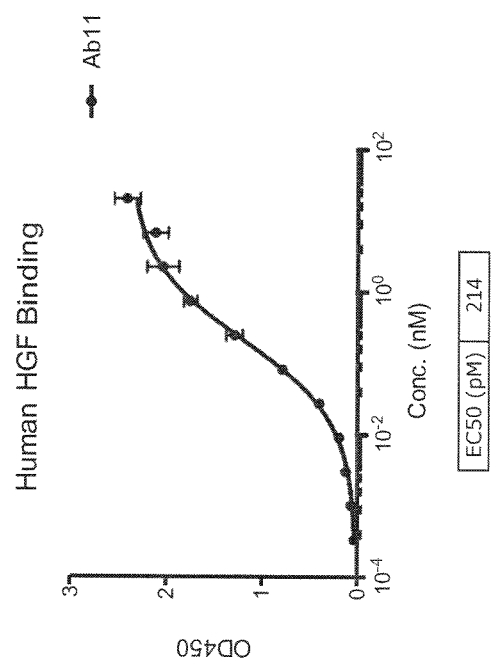
FIG. 11 provides the human-HGF ELISA binding data obtained following the protocol in Example 8 infra for antibody Ab11.
Figure 12:
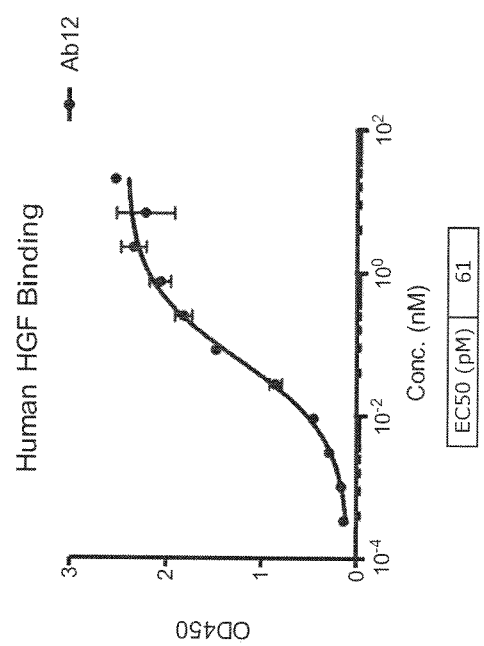
FIG. 12 provides the human-HGF ELISA binding data obtained following the protocol in Example 8 infra for antibody Ab12.
Figure 13:
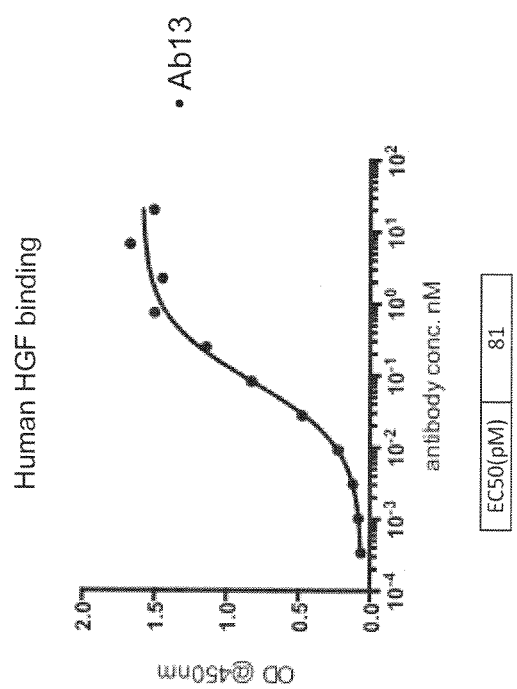
FIG. 13 provides the human-HGF ELISA binding data obtained following the protocol in Example 8 infra for antibody Ab13.
Figure 14:
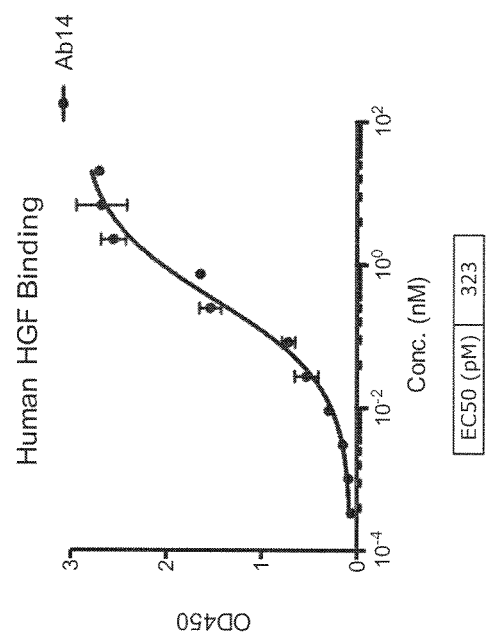
FIG. 14 provides the human-HGF ELISA binding data obtained following the protocol in Example 8 infra for antibody Ab14.
Figure 15:
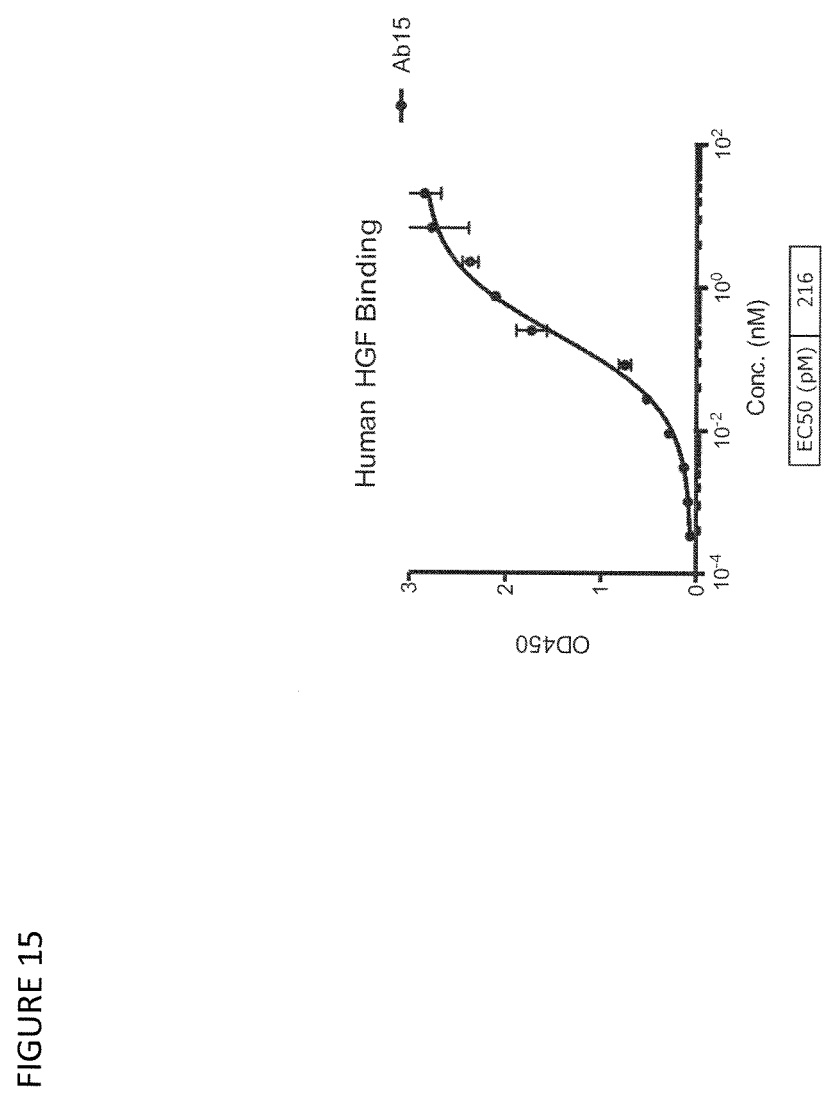
FIG. 15 provides the human-HGF ELISA binding data obtained following the protocol in Example 8 infra for antibody Ab15.
Figure 16:
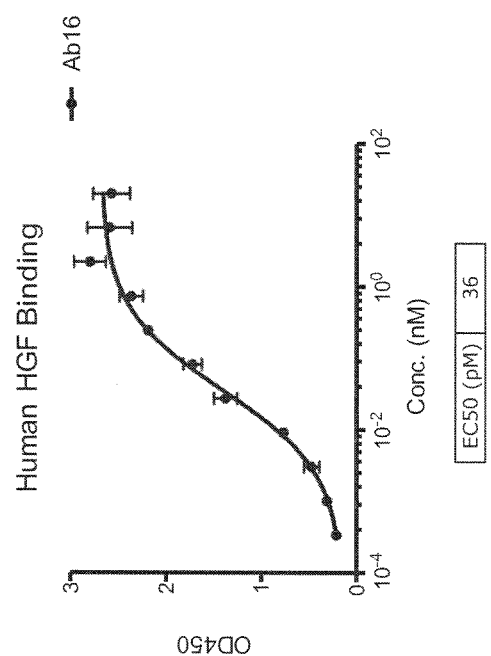
FIG. 16 provides the human-HGF ELISA binding data obtained following the protocol in Example 8 infra for antibody Ab16.
Figure 17:
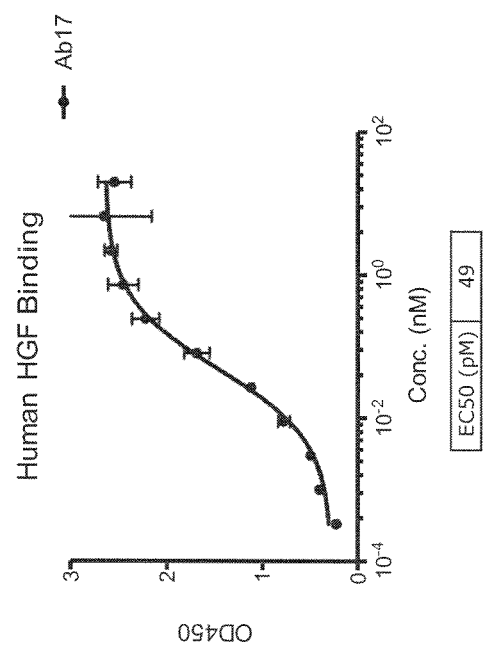
FIG. 17 provides the human-HGF ELISA binding data obtained following the protocol in Example 8 infra for antibody Ab17.
Figure 18:
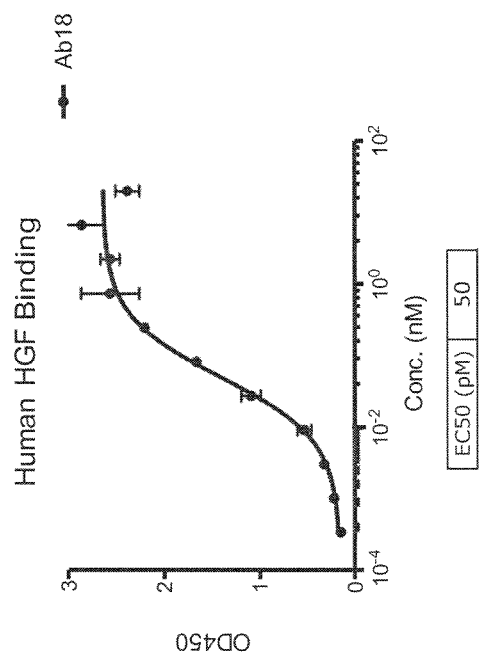
FIG. 18 provides the human-HGF ELISA binding data obtained following the protocol in Example 8 infra for antibody Ab18.
Figure 19:
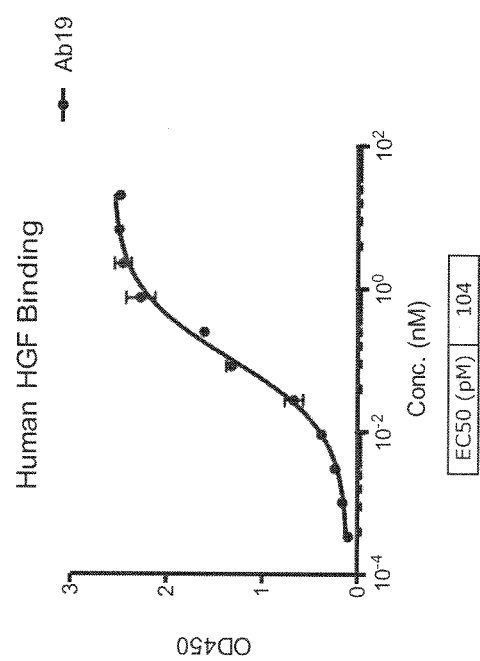
FIG. 19 provides the human-HGF ELISA binding data obtained following the protocol in Example 8 infra for antibody Ab19.
Figure 20:
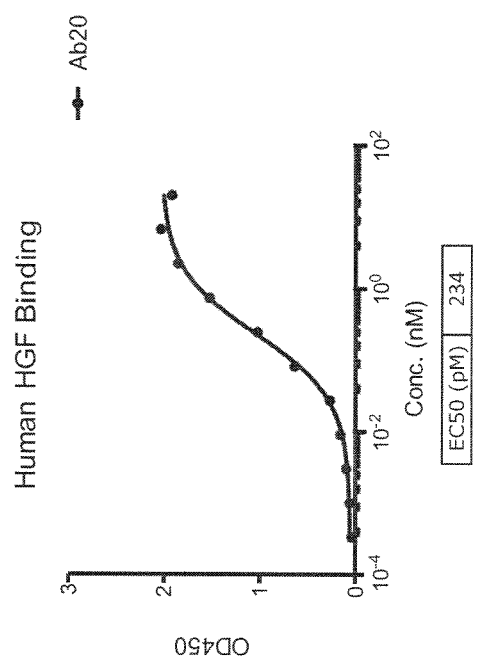
FIG. 20 provides the human-HGF ELISA binding data obtained following the protocol in Example 8 infra for antibody Ab20.
Figure 21:
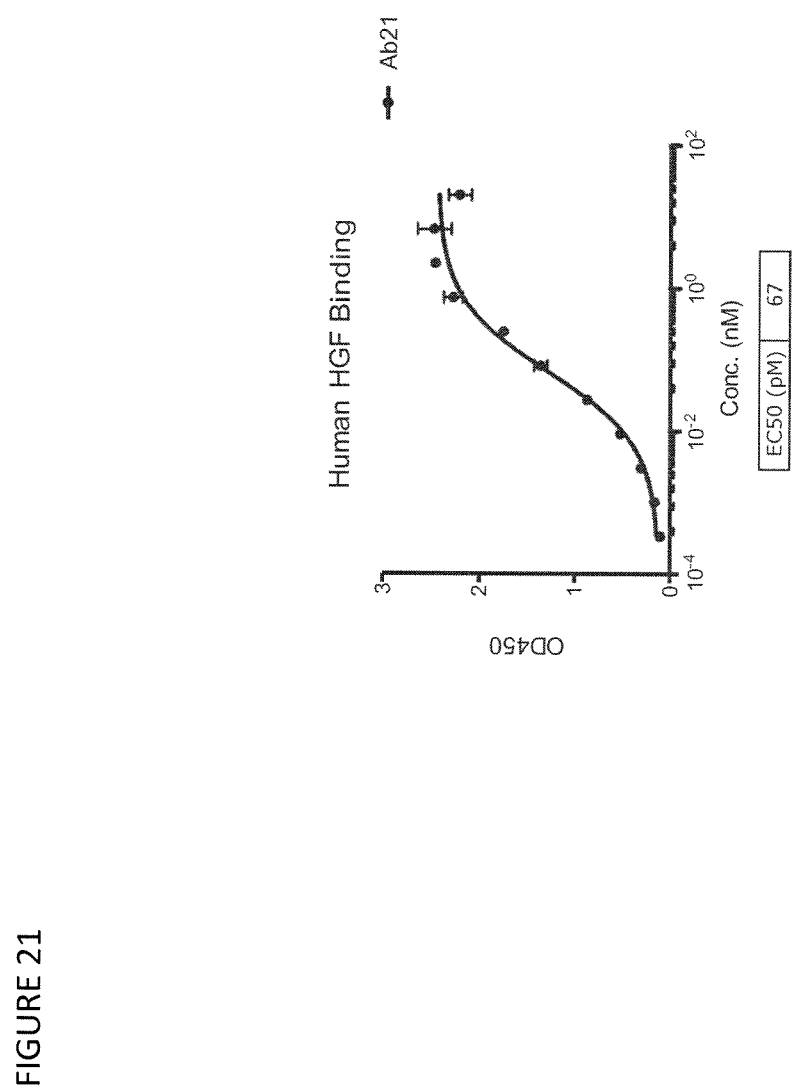
FIG. 21 provides the human-HGF ELISA binding data obtained following the protocol in Example 8 infra for antibody Ab21.
Figure 22:
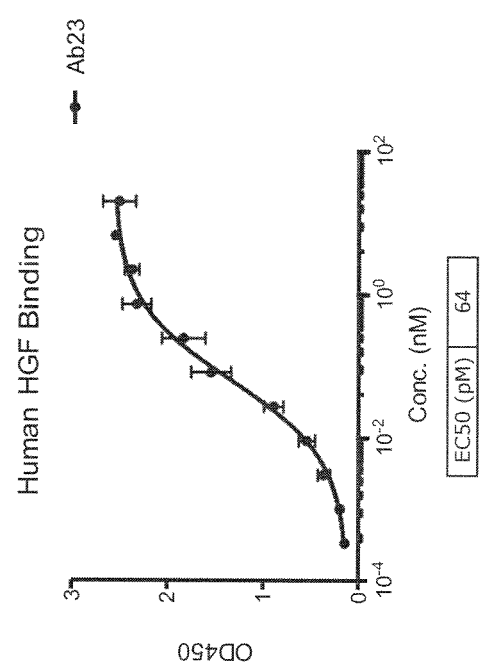
FIG. 22 provides the human-HGF ELISA binding data obtained following the protocol in Example 8 infra for antibody Ab23.
Figure 23:
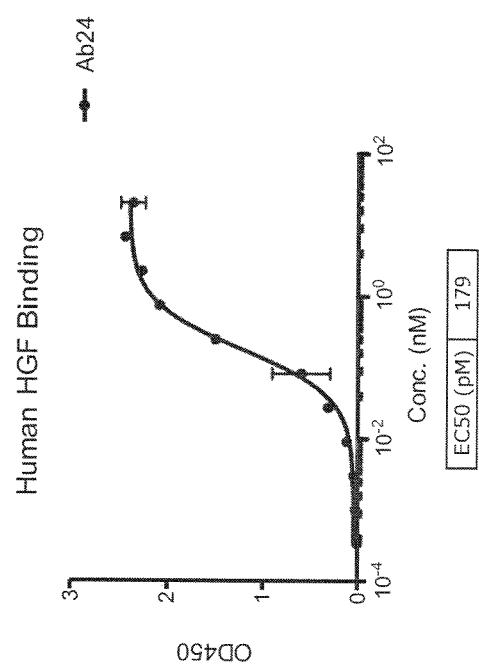
FIG. 23 provides the human-HGF ELISA binding data obtained following the protocol in Example 8 infra for antibody Ab24.
Figure 24:
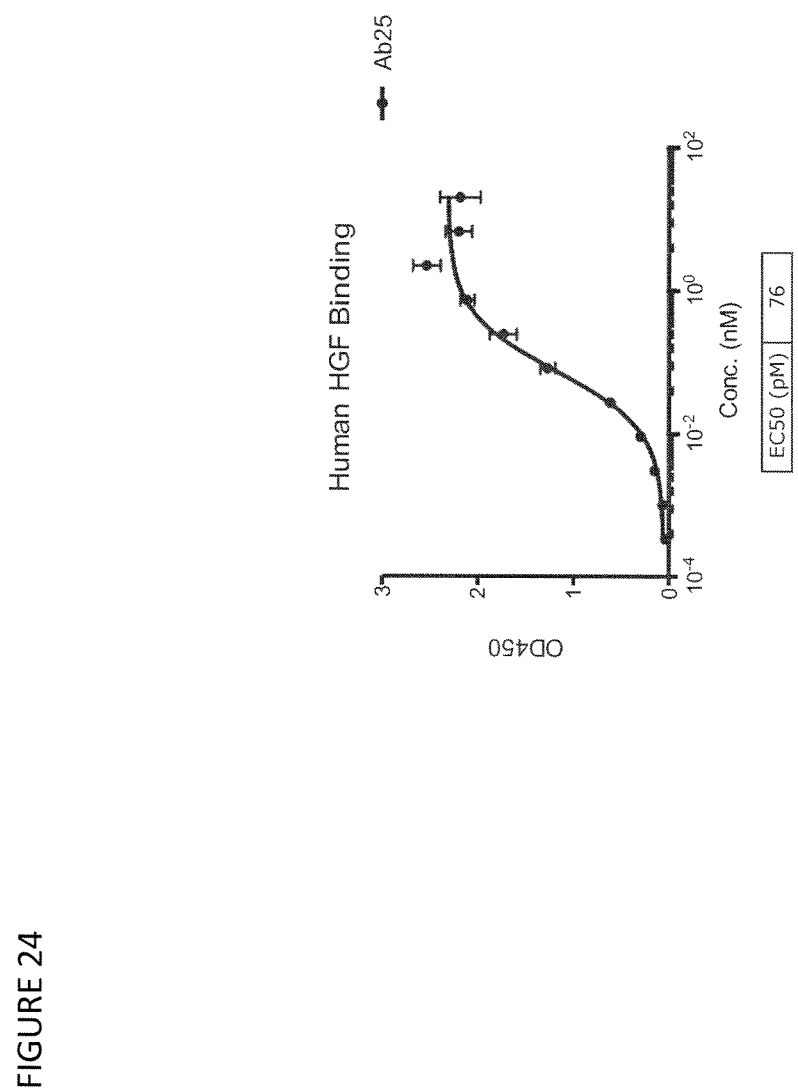
FIG. 24 provides the human-HGF ELISA binding data obtained following the protocol in Example 8 infra for antibody Ab25.
Figure 25:
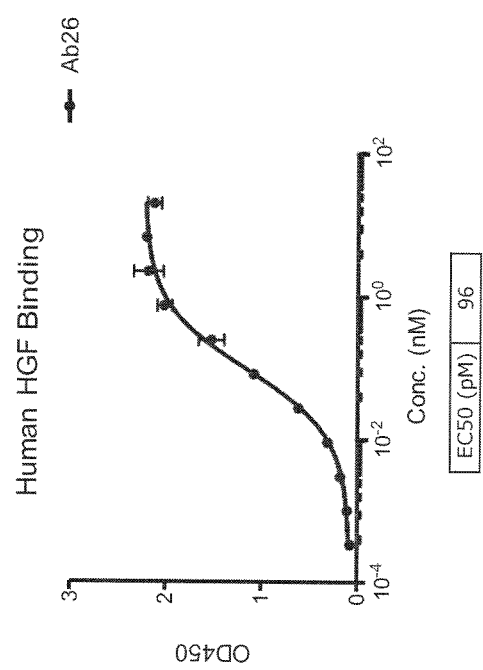
FIG. 25 provides the human-HGF ELISA binding data obtained following the protocol in Example 8 infra for antibody Ab26.
Figure 26:
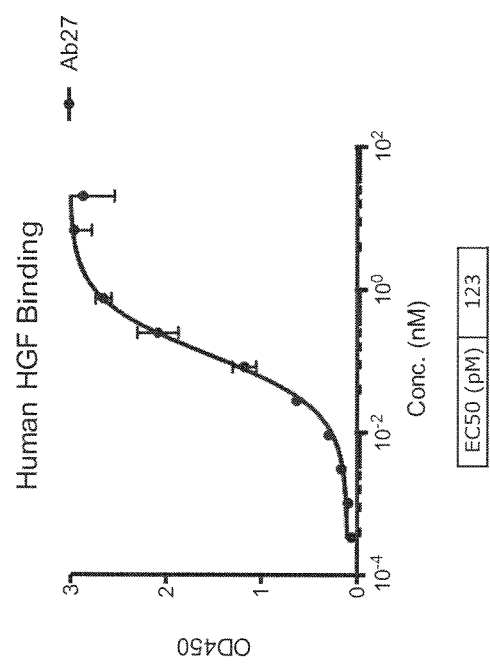
FIG. 26 provides the human-HGF ELISA binding data obtained following the protocol in Example 8 infra for antibody Ab27.
Figure 27:
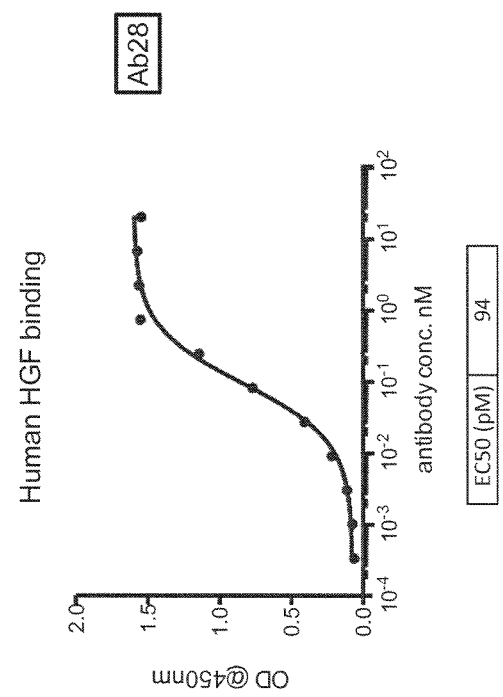
FIG. 27 provides the human-HGF ELISA binding data obtained following the protocol in Example 8 infra for antibody Ab28.

Ab21 and Ab23-28 aligned by their framework regions (FR), complementarity determining regions (CDRs), and constant regions.

FIG. 55A-55J provide the polynucleotide sequences encoding the full-length light chain for antibodies Ab1-Ab21 and Ab23-28 aligned by their framework regions (FR), complementarity determining regions (CDRs), and constant regions.

FIG. 56 provides the polypeptide sequence coordinates for the variable region and complementarity determining regions (CDRs) of the heavy chain for antibodies Ab1-Ab21 and Ab23-28.

FIG. 57 provides the polypeptide sequence coordinates for the constant region and framework regions (FR) of the heavy chain for antibodies Ab1-Ab21, and Ab23-28.

FIG. 58 provides the polypeptide sequence coordinates for the variable region and complementarity determining regions (CDRs) of the light chain for antibodies Ab1-Ab21 and Ab23-28.

FIG. 59 provides the polypeptide sequence coordinates for the constant region and framework regions (FR) of the light chain for antibodies Ab1-Ab21, and Ab23-28.

FIG. 60 provides the polynucleotide sequence coordinates for the variable region and complementarity determining regions (CDRs) of the heavy chain for antibodies Ab1-Ab21 and Ab23-28.

FIG. 61 provides the polynucleotide sequence coordinates for the constant region and framework regions (FR) of the heavy chain for antibodies Ab1-Ab21 and Ab23-28.

FIG. 62 provides the polynucleotide sequence coordinates for the variable region and complementarity determining regions (CDRs) of the light chain for antibodies Ab1-Ab21 and Ab23-28.

FIG. 63 provides the polynucleotide sequence coordinates for the constant region and framework regions (FR) of the light chain for antibodies Ab1-Ab21, and Ab23-28.

DETAILED DESCRIPTION OF PREFERRED EMBODIMENTS

Definitions

It is to be understood that this invention is not limited to the particular methodology, protocols, cell lines, animal species or genera, and reagents described, as such may vary. It is also to be understood that the terminology used herein is for the purpose of describing particular embodiments only, and is not intended to limit the scope of the present invention which will be limited only by the appended claims.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this invention belongs unless clearly indicated otherwise.

Hepatocyte Growth Factor (HGF): As used herein, HGF encompasses not only the following preproprotein amino acid sequence available as NCBI Reference Sequence: NP_000592.3 (*Homo sapiens* HGF isoform 1 preproprotein):

MWVTKLLPALLLQHVLLHLLLLPIAIPYAE-GQRKRRNTIHEFKKSAKTTL IKIDPALKIKTKKVN-TADQCANRCTRNKGLPFTCKAFVFDKARKQCLWF-PFNSMSS GVKKEFGHEFDLYENKDYIRNCII-GKGRSYKGTVSITKSGIKCQPWSSMIPHEHSFL PSSYRGKDLQENYCRNPRGEEGGPWCFTSNPE-VRYEVCDIPQCSEVECMTCNGES YRGLMDHTES-GKICQRWDHQTPHRHKFLPERYPDKGFDDNYCRN-PDGQPRPWCY TLDPHTRWEYCAIKTCAD-NTMNDTDVPLETTECIQGQGEGYRGTVNTIWN-GIPCQ RWDSQYPHEHDMTPENFKCKDLRENYCRN-PDGSESPWCFTTDPNIRVGYCSQIPN CDMSHGQD-CYRGNGKNYMGNLSQTRSGLTCSMWDKNMEDL-HRHIFWEPDASKL NENYCRNPDDDAHGPWCYTGN-PLIPWDYCPISRCEGDTTPTIVNLDHPVISCAKTK QLRVVNGIPTRTNIGWMVSLRYRNKHICGGS-LIKESWVLTARQCFPSRDLKDYEA WLGIHDVH-GRGDEKCKQVLNVSQLVYGPEGSDLVLMKLARPAV-LDDFVSTIDLP NYGCTIPEKTSCSVYGW-GYTGLINYDGLLRVAHLYIMGNEKCSQHHRGK-VTLNES EICAGAEKIGSGPCEGDYGGPLVCEQHKM-RMVLGVIVPGRGCAIPNRPGIFVRVAY YAKWIHKI-ILTYKVPQS (SEQ ID NO: 1081), but also any pro-, mature, soluble, and/or membrane-bound forms of this HGF amino acid sequence, as well as mutants (mutiens), splice variants, isoforms, orthologs, homologues and variants of this sequence.

Hepatocyte Growth Factor Receptor (HGF-R): As used herein, the terms "HGF-R" and "c-met" refer to a cellular receptor for hepatocyte growth factor (HGF), which typically includes an extracellular domain, a transmembrane domain and an intracellular domain, as well as variants and fragments thereof which retain the ability to bind HGF, and includes the polypeptide molecule that comprises the full-length, native amino acid sequence. Human Hepatocyte Growth Factor (HGF) is a multifunctional heterodimeric polypeptide produced by mesenchymal cells. HGF has been shown to stimulate angiogenesis, morphogenesis and motogenesis, as well as the growth and scattering of various cell types (Bussolino et al., J. Cell. Biol. 119: 629, 1992; Zarnegar and Michalopoulos, J. Cell. Biol. 129:1177, 1995; Matsumoto et al., Ciba. Found. Symp. 212:198, 1997; Birchmeier and Gherardi, Trends Cell. Biol. 8:404, 1998; Xin et al. Am. J. Pathol. 158:1111, 2001). The pleiotropic activities of HGF are mediated through its receptor, a transmembrane tyrosine kinase encoded by the proto-oncogene c-met. In addition to regulating a variety of normal cellular functions, HGF and its receptor c-met have been shown to be involved in the initiation, invasion and metastasis of tumors (Jeffers et al., J. Mol. Med. 74:505, 1996; Comoglio and Trusolino, J. Clin. Invest. 109:857, 2002). HGF/c-met are coexpressed, often over-expressed, on various human solid tumors including tumors derived from lung, colon, rectum, stomach, kidney, ovary, skin, multiple myeloma and thyroid tissue (Prat et al., Int. J. Cancer 49:323, 1991; Chan et al., Oncogene 2:593, 1988; Weidner et al., Am. J. Respir. Cell. Mol. Biol. 8:229, 1993; Derksen et al., Blood 99:1405, 2002). HGF acts as an autocrine (Rong et al., Proc. Natl. Acad. Sci. USA 91:4731, 1994; Koochekpour et al., Cancer Res. 57:5391, 1997) and paracrine growth factor (Weidner et al., Am. J. Respir. Cell. Mol. Biol. 8:229, 1993) and anti-apoptotic regulator (Gao et al., J. Biol. Chem. 276:47257, 2001) for these tumors. HGF is a 102 kDa protein with sequence and structural similarity to plasminogen and other enzymes of blood coagulation (Nakamura et al., Nature 342:440, 1989; Weidner et al., Am. J. Respir. Cell. Mol. Biol. 8:229, 1993). Human HGF is synthesized as a 728 amino acid precursor (preproHGF), which undergoes intracellular cleavage to an inactive, single chain form (proHGF) (Nakamura et al., Nature 342:440, 1989; Rosen et al., J. Cell. Biol. 127:1783, 1994). Upon extracellular secretion, proHGF is cleaved to yield the biologically active disulfide-linked heterodimeric molecule composed of an a-subunit and n-subunit (Nakamura et al., Nature 342:440, 1989; Naldini et al., EMBO J. 11:4825, 1992). The alpha-subunit contains 440 residues (69 kDa with glycosylation), consisting of the N-terminal hairpin domain and four kringle domains. The beta-subunit contains 234 residues (34 kDa) and has a serine protease-like domain, which lacks proteolytic activity. HGF has two unique cell specific binding sites: a high affinity (Kd=$2\times10^{-10}$ M) binding site for the c-met receptor and a low affinity (Kd=$10^{-9}$ M) binding site for heparin sulfate proteoglycans (HSPG), which are present on the cell surface and extracellular matrix (Naldini et al., Oncogene 6:501, 1991; Bardelli et al., J. Biotechnol. 37:109, 1994; Sakata et al., J. Biol. Chem., 272:9457, 1997).

"C-met" or "HGF-R" is a member of the class IV protein tyrosine kinase receptor family. The full length c-met gene was cloned and identified as the c-met proto-oncogene (Cooper et al., Nature 311:29, 1984; Park et al., Proc. Natl. Acad. Sci. USA 84:6379, 1987). NK2 (a protein encompassing the N-terminus and first two kringle domains of the alpha-subunit) is sufficient for binding to c-met and activation of the signal cascade for motility, however the full length protein is required for the mitogenic response (Weidner et al., Am. J. Respir. Cell. Mol. Biol. 8:229, 1993). HSPG binds to HGF by interacting with the N terminus of HGF. HGF/c-met have been reported to play important roles in several aspects of cancer development such as tumor initiation, invasion, metastasis, regulation of apoptosis and angiogenesis. Several different approaches have been investigated to obtain an effective antagonistic molecule: truncated HGF proteins such as NK1 (N terminal domain plus kringle domain 1; Lokker et al., J. Biol. Chem. 268:17145, 1993), NK2 (N terminal domain plus kringle domains 1 and 2; Chan et al., Science 254:1382, 1991) and NK4 (N-terminal domain plus four kringle domains; Kuba et al., Cancer Res. 60:6737, 2000), anti-c-met mAbs (Dodge, Master's Thesis, San Francisco State University, 1998) and anti-HGF mAbs (Cao et al., Proc. Natl. Acad. Sci. USA 98:7443, 2001).

The term "Neutralizing or Antagonizing Anti-HGF antibody or antibody fragment" or "HGF Antibody Antagonist" herein refers to a monoclonal antibody (mAb) that binds HGF (i.e., an anti-HGF mAb), wherein the binding partially or completely inhibits one or more biological activities of HGF (i.e., when the mAb is used as a single agent). Among the biological properties of HGF that a neutralizing antibody may inhibit are the ability of HGF to bind to its c-met receptor, to cause the scattering of certain cell lines such as Madin-Darby canine kidney (MDCK) cells; to stimulate proliferation of (i.e., be mitogenic for) certain cells including hepatocytes, Mv 1 Lu mink lung epithelial cells, and various human tumor cells; to cause scattering of specific cells, to stimulate angiogenesis, for example as measured by stimulation of human umbilical vascular endothelial cell (HUVEC) proliferation or tube formation or by induction of blood vessels when applied to the chick embryo chorioallantoic membrane (CAM), to promote cell invasion or metastasis, and to promote fibrosis.

A "blocking" antibody or an "antagonist" antibody preferably is one which inhibits or reduces biological activity of the antigen it binds (for e.g., activated HGF beta-chain or site/epitope on c-met to which activated HGF beta binds). Preferred blocking antibodies or antagonist antibodies substantially or completely inhibit the biological activity of the antigen.

An "agonist antibody", as used herein, is an antibody which mimics at least one of the functional activities of a polypeptide of interest (for e.g., an antibody could provide at least one of the c-met activating functions of activated HGF beta chain).

A "disorder" is any condition that would benefit from treatment with a substance/molecule or method of the invention. This includes chronic and acute disorders or diseases including those pathological conditions which predispose the mammal to the disorder in question. Non-limiting examples of disorders to be treated herein include malignant and benign tumors; non-leukemias and lymphoid malignancies; neuronal, glial, astrocytal, hypothalamic and other glandular, macrophagal, epithelial, stromal and blastocoelic disorders; and inflammatory, immunologic and other angiogenesis-related disorders.

The terms "cell proliferative disorder" and "proliferative disorder" refer to disorders that are associated with some degree of abnormal cell proliferation. In one embodiment, the cell proliferative disorder is cancer.

"Tumor", as used herein, refers to all neoplastic cell growth and proliferation, whether malignant or benign, and all pre-cancerous and cancerous cells and tissues. The terms "cancer", "cancerous", "cell proliferative disorder", "proliferative disorder" and "tumor" are not mutually exclusive as referred to herein.

The terms "cancer" and "cancerous" refer to or describe the physiological condition in mammals that is typically characterized by unregulated cell growth/proliferation. Examples of cancer include but are not limited to, carcinoma, lymphoma, blastoma, sarcoma, and leukemia. More particular examples of such cancers include squamous cell cancer, small-cell lung cancer, non-small cell lung cancer, adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, liver cancer, prostate cancer, vulval cancer, thyroid cancer, hepatic carcinoma and various types of head and neck cancer.

As used herein, "treatment" refers to clinical intervention in an attempt to alter the natural course of the individual or cell being treated, and can be performed either for prophylaxis or during the course of clinical pathology. Desirable effects of treatment include preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, antibodies of the invention are used to delay development of a disease or disorder.

An "effective amount" refers to an amount effective, at dosages and for periods of time necessary, to achieve the desired therapeutic or prophylactic result. A "therapeutically effective amount" of a substance/molecule of the invention, agonist or antagonist may vary according to factors such as the disease state, age, sex, and weight of the individual, and the ability of the substance/molecule, agonist or antagonist to elicit a desired response in the individual. A therapeutically effective amount is also one in which any toxic or detrimental effects of the substance/molecule, agonist or antagonist are outweighed by the therapeutically beneficial effects.

A "prophylactically effective amount" refers to an amount effective, at dosages and for periods of time necessary, to achieve the desired prophylactic result. Typically but not necessarily, since a prophylactic dose is used in subjects prior to or at an earlier stage of disease, the prophylactically effective amount will be less than the therapeutically effective amount.

The term "cytotoxic agent" as used herein refers to a substance that inhibits or prevents the function of cells and/or causes destruction of cells. The term is intended to include radioactive isotopes (e.g., $At^{211}$, $I^{131}$, $I^{125}$, $Y^{90}$, $Re^{186}$, $Re^{188}$, $Sm^{153}$, $Bi^{212}$, $P^{32}$ and radioactive isotopes of Lu), chemotherapeutic agents e.g. methotrexate, adriamicin, vinca alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below. A tumoricidal agent causes destruction of tumor cells.

A "chemotherapeutic agent" is a chemical compound useful in the treatment of a proliferative disease such as cancer. Examples of chemotherapeutic agents include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfomithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; CPT-11; topoisomerase inhibitor RFS 2000; difluoromethylornithine (DMFO); retinoids such as retinoic acid; capecitabine; and pharmaceutically acceptable salts, acids or derivatives of any of the above.

Also included in the definition of "chemotherapeutic agent" above are anti-hormonal agents that act to regulate or inhibit hormone action on tumors such as anti-estrogens and selective estrogen receptor modulators (SERMs), including, for example, tamoxifen (including NOLVADEX® tamoxifen), raloxifene, droloxifene, 4-hydroxytamoxifen, trioxifene, keoxifene, LY117018, onapristone, and FARESTON, toremifene; aromatase inhibitors that inhibit the enzyme aromatase, which regulates estrogen production in the adrenal glands, such as, for example, 4(5)-imidazoles, aminoglutethimide, MEGASE® megestrol acetate, AROMASIN® exemestane, formestanie, fadrozole, RIVISOR® vorozole, FEMARA® letrozole, and ARIMIDEX® anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those which inhibit expression of genes in signaling pathways implicated in abherant cell proliferation, such as, for example, PKC-alpha, Ralf and H-Ras; ribozymes such as a VEGF expression inhibitor (e.g., ANGIOZYME® ribozyme) and a HER2 expression inhibitor; vaccines such as gene therapy vaccines, for example, ALLOVECTIN® vaccine, LEUVECTINO vaccine, and VAXID® vaccine; PROLEUKIN® rIL-2; LURTOTECAN® topoisomerase 1 inhibitor; ABARELIX® rmRH; and pharmaceutically acceptable salts, acids or derivatives of any of the above.

A "growth inhibitory agent" when used herein refers to a compound or composition which inhibits growth of a cell whose growth is dependent upon HGF/c-met activation either in vitro or in vivo. Thus, the growth inhibitory agent may be one which significantly reduces the percentage of HGF/c-met-dependent cells in S phase. Examples of growth inhibitory agents include agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in The Molecular Basis of Cancer, Mendelsohn and Israel, eds., Chapter 1, entitled "Cell cycle regulation, oncogenes, and antineoplastic drugs" by Murakami et al. (WB Saunders: Philadelphia, 1995), especially p. 13. The taxanes (paclitaxel and docetaxel) are anticancer drugs both derived from the yew tree. Docetaxel (TAXOTERE®, Rhone-Poulenc Rorer), derived from the European yew, is a semisynthetic analogue of paclitaxel (TAXOL®, Bristol-Myers Squibb). Paclitaxel and docetaxel promote the assembly of microtubules from tubulin dimers and stabilize microtubules by preventing depolymerization, which results in the inhibition of mitosis in cells.

"Doxorubicin" is an anthracycline antibiotic. The full chemical name of doxorubicin is (8S-cis)-10-[(3-amino-2,3,6-trideoxy-alpha-L-lyxo-hexapyranosyl)oxy]-7,-8,9,10-tetrahydro-6,8,11-trihydroxy-8-(hydroxyacetyl)-1-methoxy-5,12-naphthacenedione.

The terms "cell proliferative disorder" and "proliferative disorder" herein refer to disorders that are associated with some degree of abnormal cell proliferation. In one embodiment, the cell proliferative disorder is cancer or a tumor. As noted previously, a "tumor", as used herein, refers to all neoplastic cell growth and proliferation, whether malignant or benign, and all pre-cancerous and cancerous cells and tissues. The terms "cancer", "cancerous", "cell proliferative disorder", "proliferative disorder" and "tumor" are not mutually exclusive as referred to herein.

The terms "cancer" and "cancerous" refer to or describe the physiological condition in mammals that is typically characterized by unregulated cell growth/proliferation. Examples of cancer include but are not limited to, carcinoma, lymphoma, blastoma, sarcoma, and leukemia. More particular examples of such cancers include squamous cell cancer, small-cell lung cancer, non-small cell lung cancer, adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, liver cancer, prostate cancer, vulval cancer, thyroid cancer, hepatic carcinoma and various types of head and neck cancer.

The term "Dysregulation of angiogenesis" herein includes any condition wherein there is aberrant angiogenesis. This includes both non-neoplastic and neoplastic conditions. Neoplastics include but are not limited to cancers described above. Non-neoplastic disorders include but are not limited to undesired or aberrant hypertrophy, arthritis, rheumatoid arthritis (RA), psoriasis, psoriatic plaques, sarcoidosis, atherosclerosis, atherosclerotic plaques, diabetic and other proliferative retinopathies including retinopathy of prematurity, retrolental fibroplasia, neovascular glaucoma, age-related macular degeneration, diabetic macular edema, corneal neovascularization, corneal graft neovascularization, corneal graft rejection, retinal/choroidal neovascularization, neovascularization of the angle (rubeosis), ocular neovascular disease, vascular restenosis, arteriovenous malformations (AVM), meningioma, hemangioma, angiofibroma, thyroid hyperplasias (including Grave's disease), corneal and other tissue transplantation, chronic inflammation, lung inflammation, acute lung injury/ARDS, sepsis, primary pulmonary hypertension, malignant pulmonary effusions, cerebral edema (e.g., associated with acute stroke/closed head injury/trauma), synovial inflammation, pannus formation in RA, myositis ossificans, hypertropic bone formation, osteoarthritis (OA), refractory ascites, polycystic ovarian disease, endometriosis, 3rd spacing of fluid diseases (pancreatitis, compartment syndrome, burns, bowel disease), uterine fibroids, premature labor, chronic inflammation such as IBD (Crohn's disease and ulcerative colitis), renal allograft rejection, inflammatory bowel disease, nephrotic syndrome, undesired or aberrant tissue mass growth (non-cancer), hemophilic joints, hypertrophic scars, inhibition of hair growth, Osler-Weber syndrome, pyogenic granuloma retrolental fibroplasias, scleroderma, trachoma, vascular adhesions, synovitis, dermatitis, preeclampsia, ascites, pericardial effusion (such as that associated with pericarditis), and pleural effusion.

The term "Recombinant cell" or "recombinant host cell" herein in general refers to any cell engineered to express one or more antibody polypeptides according to the invention. This includes by way of example bacterial, fungal, yeast, mammalian, invertebrate such as insect, plant and avian cells. Preferred host cells are yeast, fungi, especially filamentous fungi and mammalian cells. Yeast and filamentous fungi include, but are not limited to *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia sp., Saccharomyces cerevisiae, Saccharomyces sp., Hansenula polymorpha, Kluyveromyces sp., Kluyveromyces lactis, Candida albicans, Aspergillus nidulans, Aspergillus niger, Aspergillus oryzae, Trichoderma reesei, Chrysosporium lucknowense, Fusarium sp., Fusarium gramineum, Fusarium venenatum, Physcomitrella patens* and *Neurospora crassa*. *Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp. and *Neurospora crassa*.

Examples of invertebrate cells include insect cells such as Drosophila S2 and Spodoptera Sf9, as well as plant cells.

Examples of useful mammalian host cell lines include Chinese hamster ovary (CHO) and COS cells. More specific examples include monkey kidney CV1 line transformed by SV40 (COS-7, ATCC CRL 1651); human embryonic kidney line (293 or 293 cells subcloned for growth in suspension culture, Graham et al., J. Gen Virol., 36:59 (1977)); Chinese hamster ovary cells/-DHFR(CHO, Urlaub and Chasin, Proc. Natl. Acad. Sci. USA, 77:4216 (1980)); mouse sertoli cells (TM4, Mather, Biol. Reprod., 23:243-251 (1980)); human lung cells (W138, ATCC CCL 75); human liver cells (Hep G2, HB 8065); and mouse mammary tumor (MMT 060562, ATCC CCL51). The selection of the appropriate host cell is deemed to be within the skill in the art. Preferred mammalian cells for antibody expression include CHO cells and COS cells. In an exemplary embodiment the recombinant host cells are haploidal or polyploidal yeast cells of the genus *Pichia*.

Mating competent yeast species: In the present invention this is intended to broadly encompass any diploid or tetraploid yeast which can be grown in culture. Such species of yeast may exist in a haploid, diploid, or other polyploid form. The cells of a given ploidy may, under appropriate conditions, proliferate for an indefinite number of generations in that form. Diploid cells can also sporulate to form haploid cells. Sequential mating can result in tetraploid strains through further mating or fusion of diploid strains. The present invention contemplates the use of haploid yeast, as well as diploid or other polyploid yeast cells produced, for example, by mating or spheroplast fusion.

Mating competent yeast include yeast which are a member of the Saccharomycetaceae family, which includes the genera *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis;* and *Zygosaccharomyces*. Other types of yeast potentially useful in the invention include *Yarrowia; Rhodosporidium; Candida; Hansenula; Filobasium; Sporidiobolus; Bullera; Leucosporidium* and *Filobasidella*.

In a preferred embodiment of the invention, the mating competent yeast is a member of the genus *Pichia*. In a further preferred embodiment of the invention, the mating competent yeast of the genus *Pichia* is one of the following species: *Pichia pastoris, Pichia methanolica,* and *Hansenula polymorpha (Pichia angusta)*. In a particularly preferred embodiment of the invention, the mating competent yeast of the genus *Pichia* is the species *Pichia pastoris*.

Haploid Yeast Cell: A cell having a single copy of each gene of its normal genomic (chromosomal) complement.

Polyploid Yeast Cell: A cell having more than one copy of its normal genomic (chromosomal) complement.

Diploid Yeast Cell: A cell having two copies (alleles) of essentially every gene of its normal genomic complement, typically formed by the process of fusion (mating) of two haploid cells.

Tetraploid Yeast Cell: A cell having four copies (alleles) of essentially every gene of its normal genomic complement, typically formed by the process of fusion (mating) of two haploid cells. Tetraploids may carry two, three, four or more different expression cassettes. Such tetraploids might be obtained in *S. cerevisiae* by selective mating homozygotic heterothallic a/a and alpha/alpha diploids and in *Pichia* by sequential mating of haploids to obtain auxotrophic diploids. For example, a [met his] haploid can be mated with [ade his] haploid to obtain diploid [his]; and a [met arg] haploid can be mated with [ade arg] haploid to obtain diploid [arg]; then the diploid [his]×diploid [arg] to obtain a tetraploid prototroph. It will be understood by those of skill in the art that reference to the benefits and uses of diploid cells may also apply to tetraploid cells.

Yeast Mating: The process by which two haploid yeast cells naturally fuse to form one diploid yeast cell.

Meiosis: The process by which a diploid yeast cell undergoes reductive division to form four haploid spore products. Each spore may then germinate and form a haploid vegetatively growing cell line.

Selectable Marker: A selectable marker is a gene or gene fragment that confers a growth phenotype (physical growth characteristic) on a cell receiving that gene as, for example through a transformation event. The selectable marker allows that cell to survive and grow in a selective growth medium under conditions in which cells that do not receive that selectable marker gene cannot grow. Selectable marker genes generally fall into several types, including positive selectable marker genes such as a gene that confers on a cell resistance to an antibiotic or other drug, temperature when two temperature sensitive ("ts") mutants are crossed or a is mutant is transformed; negative selectable marker genes such as a biosynthetic gene that confers on a cell the ability to grow in a medium without a specific nutrient needed by all cells that do not have that biosynthetic gene, or a mutagenized biosynthetic gene that confers on a cell inability to grow by cells that do not have the wild type gene; and the like. Suitable markers include but are not limited to: ZEO; G418; LYS3; MET1; MET3a; ADE1; ADE3; URA3; and the like.

Expression Vector: These DNA vectors contain elements that facilitate manipulation for the expression of a foreign protein within the target host cell. Conveniently, manipulation of sequences and production of DNA for transformation is first performed in a bacterial host, e.g. *E. coli*, and usually vectors will include sequences to facilitate such manipulations, including a bacterial origin of replication and appropriate bacterial selection marker. Selection markers encode proteins necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, (b) complement auxotrophic deficiencies, or (c) supply critical nutrients not available from complex media. Exemplary vectors and methods for transformation of yeast are described, for example, in Burke, D., Dawson, D., & Stearns, T. (2000). Methods in yeast genetics: a Cold Spring Harbor Laboratory course manual. Plainview, N.Y.: Cold Spring Harbor Laboratory Press.

Expression vectors for use in the methods of the invention will further include a selectable auxotrophic or drug marker for identifying transformed cells such as yeast strains A drug marker may further be used to amplify copy number of the vector in a host cell.

The polypeptide coding sequence of interest is operably linked to transcriptional and translational regulatory sequences that provide for expression of the polypeptide in yeast cells. These vector components may include, but are not limited to, one or more of the following: an enhancer element, a promoter, and a transcription termination sequence. Sequences for the secretion of the polypeptide may also be included, e.g. a signal sequence, and the like. An origin of replication is optional, as expression vectors are often integrated into the host, e.g., yeast genome. In one embodiment of the invention, the polypeptide of interest is operably linked, or fused, to sequences providing for optimized secretion of the polypeptide from yeast diploid cells.

Nucleic acids are "operably linked" when placed into a functional relationship with another nucleic acid sequence. For example, DNA for a signal sequence is operably linked to DNA for a polypeptide if it is expressed as a preprotein that participates in the secretion of the polypeptide; a promoter or enhancer is operably linked to a coding sequence if it affects the transcription of the sequence. Generally, "operably linked" means that the DNA sequences being linked are contiguous, and, in the case of a secretory leader, contiguous and in reading frame. However, enhancers do not have to be contiguous. Linking is accomplished by ligation at convenient restriction sites or alternatively via a PCR/recombination method familiar to those skilled in the art (Gateway® Technology; Invitrogen, Carlsbad Calif.). If such sites do not exist, the synthetic oligonucleotide adapters or linkers are used in accordance with conventional practice.

Promoters are untranslated sequences located upstream (5') to the start codon of a structural gene (generally within about 100 to 1000 bp) that control the transcription and translation of particular nucleic acid sequences to which they are operably linked. Such promoters fall into several classes: inducible, constitutive, and repressible promoters (that increase levels of transcription in response to absence of a repressor). Inducible promoters may initiate increased levels of transcription from DNA under their control in response to some change in culture conditions, e.g., the presence or absence of a nutrient or a change in temperature.

The promoter fragment may also serve as the site for homologous recombination and integration of the expression vector into the same site in the host genome; alternatively a selectable marker is used as the site for homologous recombination.

Examples of suitable promoters useful in *Pichia* include the AOX1 and promoter (Cregg et al. (1989) *Mol. Cell. Biol.* 9:1316-1323); ICL1 promoter (Menendez et al. (2003) *Yeast* 20(13): 1097-108); glyceraldehyde-3-phosphate dehydrogenase promoter (GAP) (Waterham et al. (1997) *Gene* 186(1): 37-44); and FLD1 promoter (Shen et al. (1998) *Gene* 216(1):93-102). The GAP promoter is a strong constitutive promoter and the AOX and FLD1 promoters are inducible.

Other yeast promoters include ADH1, alcohol dehydrogenase II, GAL4, PHO3, PHO5, Pyk, and chimeric promoters derived therefrom. Additionally, non-yeast promoters may be used in the invention such as mammalian, insect, plant, reptile, amphibian, bacterial, fungal, viral, and avian promoters. Most typically the promoter will comprise a mammalian promoter (potentially endogenous to the expressed genes) or will comprise a yeast or viral promoter that provides for efficient transcription in yeast systems.

The polypeptides of interest may be produced recombinantly not only directly, but also as a fusion polypeptide with a heterologous polypeptide, e.g. a signal sequence or other polypeptide having a specific cleavage site at the N-terminus of the mature protein or polypeptide. In general, the signal sequence may be a component of the vector, or it may be a part of the polypeptide coding sequence that is inserted into the vector. The heterologous signal sequence selected preferably is one that is recognized and processed through one of the standard pathways available within the host cell. The *S. cerevisiae* alpha factor pre-pro signal has proven effective in the secretion of a variety of recombinant proteins from *P. pastoris*. Other yeast signal sequences include the alpha mating factor signal sequence, the invertase signal sequence, and signal sequences derived from other secreted yeast polypeptides. Additionally, these signal peptide sequences may be engineered to provide for enhanced secretion in diploid yeast expression systems. Other secretion signals of interest also include mammalian signal sequences, which may be heterologous to the protein being secreted, or may be a native sequence for the protein being secreted. Signal sequences include pre-peptide sequences, and in some instances may include propeptide sequences. Many such signal sequences are known in the art, including the signal sequences found on immunoglobulin chains, e.g., K28 preprotoxin sequence, PHA-E, FACE, human MCP-1, human serum albumin signal sequences, human Ig heavy chain, human Ig light chain, and the like. For example, see Hashimoto et. al. Protein Eng 11(2) 75 (1998); and Kobayashi et. al. Therapeutic Apheresis 2(4) 257 (1998).

Transcription may be increased by inserting a transcriptional activator sequence into the vector. These activators are cis-acting elements of DNA, usually about from 10 to 300 bp, which act on a promoter to increase its transcription. Transcriptional enhancers are relatively orientation and position independent, having been found 5' and 3' to the transcription unit, within an intron, as well as within the coding sequence itself. The enhancer may be spliced into the expression vector at a position 5' or 3' to the coding sequence, but is preferably located at a site 5' from the promoter.

Expression vectors used in eukaryotic host cells may also contain sequences necessary for the termination of transcription and for stabilizing the mRNA. Such sequences are commonly available from 3' to the translation termination codon, in untranslated regions of eukaryotic or viral DNAs or cDNAs. These regions contain nucleotide segments transcribed as polyadenylated fragments in the untranslated portion of the mRNA.

Construction of suitable vectors containing one or more of the above-listed components employs standard ligation techniques or PCR/recombination methods. Isolated plasmids or DNA fragments are cleaved, tailored, and re-ligated in the form desired to generate the plasmids required or via recombination methods. For analysis to confirm correct sequences in plasmids constructed, the ligation mixtures are used to transform host cells, and successful transformants selected by antibiotic resistance (e.g. ampicillin or Zeocin) where appropriate. Plasmids from the transformants are prepared, analyzed by restriction endonuclease digestion and/or sequenced.

As an alternative to restriction and ligation of fragments, recombination methods based on att sites and recombination enzymes may be used to insert DNA sequences into a vector. Such methods are described, for example, by Landy (1989) Ann. Rev. Biochem. 58:913-949; and are known to those of skill in the art. Such methods utilize intermolecular DNA recombination that is mediated by a mixture of lambda and *E. coli*-encoded recombination proteins. Recombination occurs between specific attachment (att) sites on the interacting DNA molecules. For a description of att sites see Weisberg and Landy (1983) Site-Specific Recombination in Phage Lambda, in *Lambda II*, Weisberg, ed. (Cold Spring Harbor, N.Y.: Cold Spring Harbor Press), pp. 211-250. The DNA segments flanking the recombination sites are switched, such that after recombination, the att sites are hybrid sequences comprised of sequences donated by each parental vector. The recombination can occur between DNAs of any topology.

Att sites may be introduced into a sequence of interest by ligating the sequence of interest into an appropriate vector; generating a PCR product containing att B sites through the use of specific primers; generating a cDNA library cloned into an appropriate vector containing att sites; and the like.

Folding, as used herein, refers to the three-dimensional structure of polypeptides and proteins, where interactions between amino acid residues act to stabilize the structure. While non-covalent interactions are important in determining structure, usually the proteins of interest will have intra- and/or intermolecular covalent disulfide bonds formed by two cysteine residues. For naturally occurring proteins and polypeptides or derivatives and variants thereof, the proper folding is typically the arrangement that results in optimal biological activity, and can conveniently be monitored by assays for activity, e.g. ligand binding, enzymatic activity, etc.

In some instances, for example where the desired product is of synthetic origin, assays based on biological activity will be less meaningful. The proper folding of such molecules may be determined on the basis of physical properties, energetic considerations, modeling studies, and the like.

The expression host may be further modified by the introduction of sequences encoding one or more enzymes that enhance folding and disulfide bond formation, i.e. foldases, chaperonins, etc. Such sequences may be constitutively or inducibly expressed in the yeast host cell, using vectors, markers, etc. as known in the art. Preferably the sequences, including transcriptional regulatory elements sufficient for the desired pattern of expression, are stably integrated in the yeast genome through a targeted methodology.

For example, the eukaryotic PDI is not only an efficient catalyst of protein cysteine oxidation and disulfide bond isomerization, but also exhibits chaperone activity. Co-expression of PDI can facilitate the production of active proteins having multiple disulfide bonds. Also of interest is the expression of BIP (immunoglobulin heavy chain binding protein); cyclophilin; and the like. In one embodiment of the invention, each of the haploid parental strains expresses a distinct folding enzyme, e.g. one strain may express BIP, and the other strain may express PDI or combinations thereof.

The terms "desired protein" or "desired antibody" are used interchangeably and refer generally to a parent antibody or fragment specific to a target, i.e., HGF or a chimeric or humanized antibody or a binding portion thereof derived therefrom or one containing the same CDRs or epitopic specificity as any of the anti-HGF antibodies or fragments described herein. The term "antibody" is intended to include any polypeptide chain-containing molecular structure with a specific shape that fits to and recognizes an epitope, where one or more non-covalent binding interactions stabilize the complex between the molecular structure and the epitope. The archetypal antibody molecule is the immunoglobulin, and all types of immunoglobulins, IgG, IgM, IgA, IgE, IgD, etc., from all sources, e.g. human, rodent, rabbit, cow, sheep, pig, dog, other mammals, chicken, other avians, etc., are considered to be "antibodies." A preferred source for producing antibodies useful as starting material according to the invention is rabbits. Numerous antibody coding sequences have been described; and others may be raised by methods well-known in the art. Examples thereof include chimeric antibodies, human antibodies and other non-human mammalian antibodies, humanized antibodies, single chain antibodies (such as scFvs), camelbodies, nanobodies, IgNAR (single-chain antibodies derived from sharks), small-modular immunopharmaceuticals (SMIPs), and antibody fragments such as Fabs, Fab', F(ab')$_2$, monovalent antibody fragments such as MetMab like molecules, IgNars and the like. See Streltsov V A, et al., Structure of a shark IgNAR antibody variable domain and modeling of an early-developmental isotype, Protein Sci. 2005 November; 14(11): 2901-9. Epub 2005 Sep. 30; Greenberg A S, et al., A new antigen receptor gene family that undergoes rearrangement and extensive somatic diversification in sharks, Nature. 1995 Mar. 9; 374(6518):168-73; Nuttall S D, et al., Isolation of the new antigen receptor from wobbegong sharks, and use as a scaffold for the display of protein loop libraries, Mol. Immunol. 2001 August; 38(4):313-26; Hamers-Casterman C, et al., Naturally occurring antibodies devoid of light chains, Nature. 1993 Jun. 3; 363(6428):446-8; Gill D S, et al., Biopharmaceutical drug discovery using novel protein scaffolds, Curr Opin Biotechnol. 2006 December; 17(6): 653-8. Epub 2006 Oct. 19.

The present invention includes in particular includes monovalent antibody molecules that bind HGF, which are analogous to MetMab molecules. MetMab is a monovalent antibody specific to Met. (Met is a protein encoded by the nucleotide sequence set forth in Park et al., Proc. Natl. Acad. Sci. 84, 7479—(1987), or fragments thereof, as well as related polypeptides, which include, but are not limited to, allelic variants, splice variants, derivative variants, substitution variants, deletion variants, and/or insertion variants, fusion polypeptides, and interspecies homologs). The MetMab antibody, is a monovalent antibody known by different names including OA-5d5 (Genentech) and is also called One Armed 5d5, 5d5, MetMab, PRO143966, among others). Antibody OA-5d5, including its structure and properties, and methods for making and using it, are described in U.S. Publication No. 2007/0092520. In one embodiment, an anti-HGF antibody according to the invention may comprise a single Fab region linked to an Fc region. In such embodiment, an antibody of the invention may comprise light and heavy chain variable domains as described herein. In such an embodiment, the antibody is monovalent and may comprise an intact Fc region. In another such embodiment, the Fc region may comprise at least one protuberance (knob) and at least one cavity (hole), wherein the presence of the protuberance and cavity enhances formation of a complex between an Fc polypeptide comprising the protuberance and an Fc polypeptide comprising the cavity, for example as described in WO 2005/063816. In one embodiment, the Fc region of an antibody of the invention may comprise a first and a second Fc polypeptide, wherein the first and second polypeptide each comprises one or more mutations with respect to wild type human Fc. In one embodiment, a cavity mutation is T366S, L368A and/or Y407V. In another embodiment, a protuberance mutation is T366W. In a specific embodiment, a monovalent antibody according to the subject invention may comprise a one-armed antibody synthesized as described in WO2005/063816. In such embodiment, the one-armed antibody may comprise Fc mutations constituting "knobs" and "holes" as described in WO2005/063816. For example, a hole mutation can be one or more of T366A, L368A and/or Y407V in an Fc polypeptide, and a cavity mutation can be T366W. The invention is also directed to an anti-human HGF monovalent agent that binds with the same HGF epitope and/or competes with an anti-HGF antibody for binding to HGF as an antibody or antibody fragment disclosed herein.

For example, antibodies or antigen binding fragments may be produced by genetic engineering. In this technique, as with other methods, antibody-producing cells are sensitized to the desired antigen or immunogen. The messenger RNA isolated from antibody producing cells is used as a template to make cDNA using PCR amplification. A library of vectors, each containing one heavy chain gene and one light chain gene retaining the initial antigen specificity, is produced by insertion of appropriate sections of the amplified immunoglobulin cDNA into the expression vectors. A combinatorial library is constructed by combining the heavy chain gene library with the light chain gene library. This results in a library of clones which co-express a heavy and light chain (resembling the Fab fragment or antigen binding fragment of an antibody molecule). The vectors that carry these genes are co-transfected into a host cell. When antibody gene synthesis is induced in the transfected host, the heavy and light chain proteins self-assemble to produce active antibodies that can be detected by screening with the antigen or immunogen.

Antibody coding sequences of interest include those encoded by native sequences, as well as nucleic acids that, by virtue of the degeneracy of the genetic code, are not identical in sequence to the disclosed nucleic acids, and variants thereof. Variant polypeptides can include amino acid (aa) substitutions, additions or deletions. The amino acid substitutions can be conservative amino acid substitutions or substitutions to eliminate non-essential amino acids, such as to alter a glycosylation site, or to minimize misfolding by substitution or deletion of one or more cysteine residues that are not necessary for function. Variants can be designed so as to retain or have enhanced biological activity of a particular region of the protein (e.g., a functional domain, catalytic amino acid residues, etc). Variants also include fragments of the polypeptides disclosed herein, particularly biologically active fragments and/or fragments corresponding to functional domains. Techniques for in vitro mutagenesis of cloned genes are known. Also included in the subject invention are polypeptides that have been modified using ordinary molecular biological techniques so as to improve their resistance to proteolytic degradation or to optimize solubility properties or to render them more suitable as a therapeutic agent.

Chimeric antibodies may be made by recombinant means by combining the variable light and heavy chain regions ($V_L$ and $V_H$), obtained from antibody producing cells of one species with the constant light and heavy chain regions from another. Typically chimeric antibodies utilize rodent or rabbit variable regions and human constant regions, in order to produce an antibody with predominantly human domains. The production of such chimeric antibodies is well known in the art, and may be achieved by standard means (as described, e.g., in U.S. Pat. No. 5,624,659, incorporated herein by reference in its entirety). It is further contemplated that the human constant regions of chimeric antibodies of the invention may be selected from IgG1, IgG2, IgG3, and IgG4 constant regions.

Humanized antibodies are engineered to contain even more human-like immunoglobulin domains, and incorporate only the complementarity-determining regions of the animal-derived antibody. This is accomplished by carefully examining the sequence of the hyper-variable loops of the variable regions of the monoclonal antibody, and fitting them to the structure of the human antibody chains. Although facially complex, the process is straightforward in practice. See, e.g., U.S. Pat. No. 6,187,287, incorporated fully herein by reference.

In addition to entire immunoglobulins (or their recombinant counterparts), immunoglobulin fragments comprising the epitope binding site (e.g., Fab', F(ab')$_2$, Fab, or other fragments) may be synthesized. "Fragment" or minimal immunoglobulins may be designed utilizing recombinant immunoglobulin techniques. For instance "Fv" immunoglobulins for use in the present invention may be produced by synthesizing a fused variable light chain region and a variable heavy chain region. Combinations of antibodies are also of interest, e.g. diabodies, which comprise two distinct Fv specificities. In another embodiment of the invention, SMIPs (small molecule immunopharmaceuticals), camelbodies, nanobodies, and IgNAR are encompassed by immunoglobulin fragments.

Immunoglobulins and fragments thereof may be modified post-translationally, e.g. To add effector moieties such as chemical linkers, detectable moieties, such as fluorescent dyes, enzymes, toxins, substrates, bioluminescent materials, radioactive materials, chemiluminescent moieties and the like, or specific binding moieties, such as streptavidin, avidin, or biotin, and the like may be utilized in the methods and compositions of the present invention. Examples of additional effector molecules are provided infra.

A polynucleotide sequence "corresponds" to a polypeptide sequence if translation of the polynucleotide sequence in accordance with the genetic code yields the polypeptide sequence (i.e., the polynucleotide sequence "encodes" the polypeptide sequence), one polynucleotide sequence "corresponds" to another polynucleotide sequence if the two sequences encode the same polypeptide sequence.

A "heterologous" region or domain of a DNA construct is an identifiable segment of DNA within a larger DNA molecule that is not found in association with the larger molecule in nature. Thus, when the heterologous region encodes a mammalian gene, the gene will usually be flanked by DNA that does not flank the mammalian genomic DNA in the genome of the source organism. Another example of a heterologous region is a construct where the coding sequence itself is not found in nature (e.g., a cDNA where the genomic coding sequence contains introns, or synthetic sequences having codons different than the native gene). Allelic variations or naturally-occurring mutational events do not give rise to a heterologous region of DNA as defined herein.

A "coding sequence" is an in-frame sequence of codons that (in view of the genetic code) correspond to or encode a protein or peptide sequence. Two coding sequences correspond to each other if the sequences or their complementary sequences encode the same amino acid sequences. A coding sequence in association with appropriate regulatory sequences may be transcribed and translated into a polypeptide. A polyadenylation signal and transcription termination sequence will usually be located 3' to the coding sequence. A "promoter sequence" is a DNA regulatory region capable of binding RNA polymerase in a cell and initiating transcription of a downstream (3' direction) coding sequence. Promoter sequences typically contain additional sites for binding of regulatory molecules (e.g., transcription factors) which affect the transcription of the coding sequence. A coding sequence is "under the control" of the promoter sequence or "operatively linked" to the promoter when RNA polymerase binds the promoter sequence in a cell and transcribes the coding sequence into mRNA, which is then in turn translated into the protein encoded by the coding sequence.

Vectors are used to introduce a foreign substance, such as DNA, RNA or protein, into an organism or host cell. Typical vectors include recombinant viruses (for polynucleotides) and liposomes (for polypeptides). A "DNA vector" is a replicon, such as plasmid, phage or cosmid, to which another polynucleotide segment may be attached so as to bring about the replication of the attached segment. An "expression vector" is a DNA vector which contains regulatory sequences which will direct polypeptide synthesis by an appropriate host cell. This usually means a promoter to bind RNA polymerase and initiate transcription of mRNA, as well as ribosome binding sites and initiation signals to direct translation of the mRNA into a polypeptide(s). Incorporation of a polynucleotide sequence into an expression vector at the proper site and in correct reading frame, followed by transformation of an appropriate host cell by the vector, enables the production of a polypeptide encoded by said polynucleotide sequence.

"Amplification" of polynucleotide sequences is the in vitro production of multiple copies of a particular nucleic acid sequence. The amplified sequence is usually in the form of DNA. A variety of techniques for carrying out such amplification are described in a review article by Van Brunt (1990, Bio/Technol., 8(4):291-294). Polymerase chain reaction or PCR is a prototype of nucleic acid amplification, and use of PCR herein should be considered exemplary of other suitable amplification techniques.

The general structure of antibodies in vertebrates now is well understood (Edelman, G. M., Ann. N.Y. Acad. Sci., 190: 5 (1971)). Antibodies consist of two identical light polypeptide chains of molecular weight approximately 23,000 Daltons (the "light chain"), and two identical heavy chains of molecular weight 53,000-70,000 (the "heavy chain"). The four chains are joined by disulfide bonds in a "Y" configuration wherein the light chains bracket the heavy chains starting at the mouth of the "Y" configuration. The "branch" portion of the "Y" configuration is designated the $F_{ab}$ region; the stem portion of the "Y" configuration is designated the $F_c$ region. The amino acid sequence orientation runs from the N-terminal end at the top of the "Y" configuration to the C-terminal end at the bottom of each chain. The N-terminal end possesses the variable region having specificity for the antigen that elicited it, and is approximately 100 amino acids in length, there being slight variations between light and heavy chain and from antibody to antibody.

The variable region is linked in each chain to a constant region that extends the remaining length of the chain and that within a particular class of antibody does not vary with the specificity of the antibody (i.e., the antigen eliciting it). There are five known major classes of constant regions that determine the class of the immunoglobulin molecule (IgG, IgM, IgA, IgD, and IgE corresponding to $\gamma$, $\mu$, $\alpha$, $\delta$ and $\epsilon$ (gamma, mu, alpha, delta, or epsilon) heavy chain constant regions). The constant region or class determines subsequent effector function of the antibody, including activation of complement (Kabat, E. A., Structural Concepts in Immunology and Immunochemistry, 2nd Ed., p. 413-436, Holt, Rinehart, Winston (1976)), and other cellular responses (Andrews, D. W., et al., Clinical Immunobiology, pp 1-18, W. B. Sanders (1980); Kohl, S., et al., Immunology, 48: 187 (1983)); while the variable region determines the antigen with which it will react. Light chains are classified as either $\kappa$ (kappa) or $\lambda$ (lambda). Each heavy chain class can be prepared with either kappa or lambda light chain. The light and heavy chains are covalently bonded to each other, and the "tail" portions of the two heavy chains are bonded to each other by covalent disulfide linkages when the immunoglobulins are generated either by hybridomas or by B cells.

The expression "variable region" or "VR" refers to the domains within each pair of light and heavy chains in an antibody that are involved directly in binding the antibody to the antigen. Each heavy chain has at one end a variable domain ($V_H$) followed by a number of constant domains. Each light chain has a variable domain ($V_L$) at one end and a constant domain at its other end; the constant domain of the light chain is aligned with the first constant domain of the heavy chain, and the light chain variable domain is aligned with the variable domain of the heavy chain.

The expressions "complementarity determining region," "hypervariable region," or "CDR" refer to one or more of the hyper-variable or complementarity determining regions (CDRs) found in the variable regions of light or heavy chains of an antibody (See Kabat, E. A. et al., Sequences of Proteins of Immunological Interest, National Institutes of Health, Bethesda, Md., (1987)). These expressions include the hypervariable regions as defined by Kabat et al. ("Sequences of Proteins of Immunological Interest," Kabat E., et al., US Dept. of Health and Human Services, 1983) or the hypervariable loops in 3-dimensional structures of antibodies (Chothia and Lesk, J. Mol. Biol. 196 901-917 (1987)). The CDRs in each chain are held in close proximity by framework regions and, with the CDRs from the other chain, contribute to the formation of the antigen binding site. Within the CDRs there are select amino acids that have been described as the selectivity determining regions (SDRs) which represent the critical contact residues used by the CDR in the antibody-antigen interaction (Kashmiri, S., Methods, 36:25-34 (2005)).

An "epitope" or "binding site" is an area or region on an antigen to which an antigen-binding peptide (such as an antibody) specifically binds. A protein epitope may comprise amino acid residues directly involved in the binding (also called immunodominant component of the epitope) and other amino acid residues, which are not directly involved in the binding, such as amino acid residues which are effectively blocked by the specifically antigen binding peptide (in other words, the amino acid residue is within the "footprint" of the specifically antigen binding peptide). The term epitope herein includes both types of amino acid binding sites in any particular region of HGF that specifically binds to an anti-HGF antibody. HGF may comprise a number of different epitopes, which may include, without limitation, (1) linear peptide antigenic determinants, (2) conformational antigenic determinants which consist of one or more non-contiguous amino acids located near each other in a mature HGF conformation; and (3) post-translational antigenic determinants which consist, either in whole or part, of molecular structures covalently attached to a HGF protein such as carbohydrate groups.

The phrase that a first antibody binds "substantially" or "at least partially" the same epitope as a second antibody means that the epitope binding site for the first antibody comprises at least 10%, 20%, 30%, 40%, 50%, 60%, 70%, 80%, 90%, or more of the amino acid residues on the antigen that constitutes the epitope binding site of the second antibody. Also, that a first antibody binds substantially or partially the same or overlapping epitope as a second antibody means that the first and second antibodies compete in binding to the antigen, as described above. Thus, the term "binds to substantially the same epitope or determinant as" a monoclonal antibody means that an antibody "competes" with the antibody.

The phrase "binds to the same or overlapping epitope or determinant as" an antibody of interest means that an antibody "competes" with said antibody of interest for at least one, or all residues on HGF to which said antibody of interest specifically binds. The identification of one or more antibodies that bind(s) to substantially or essentially the same epitope as the monoclonal antibodies described herein can be readily determined using any one of variety of immunological screening assays in which antibody competition can be assessed. A number of such assays are routinely practiced and well known in the art (see, e.g., U.S. Pat. No. 5,660,827, issued Aug. 26, 1997, which is specifically incorporated herein by reference). It will be understood that actually determining the epitope to which an antibody described herein binds is not in any way required to identify an antibody that binds to the same or substantially the same or overlapping epitope as the monoclonal antibody described herein.

For example, where the test antibodies to be examined are obtained from different source animals, or are even of a different Ig isotype, a simple competition assay may be employed in which the control antibody is mixed with the test antibody and then applied to a sample containing HGF. Protocols based upon ELISAs, radioimmunoassays, Western blotting, and the use of Surface plasmone resonance (with an instrument such as the Biacore) or biolayer interferometry (with an instrument such as the Octet) analysis are suitable for use in such simple competition studies.

In certain embodiments, one would pre-mix the control anti-HGF antibody with varying amounts of the test antibody (e.g., in ratios of about 1:1, 1:2, 1:10 or about 1:100) for a period of time prior to applying to the HGF antigen sample. In other embodiments, the control and varying amounts of test antibody can simply be added separately and admixed during exposure to the HGF antigen sample. As long as one can distinguish bound from free antibodies (e.g., by using separation or washing techniques to eliminate unbound antibodies) and control antibody from the test antibody (e.g., by using species specific or isotype specific secondary antibodies or by specifically labeling the control antibody with a detectable label) one will be able to determine if the test antibody reduces the binding of the control antibody to the HGF antigens, indicating that the test antibody recognizes substantially the same epitope as the control anti-HGF antibody. The binding of the (labeled) control antibody in the presence of a completely irrelevant antibody (that does not bind HGF) can serve as the control high value. The control low value can be obtained by incubating the labeled control antibody with the same but unlabeled control antibody, where competition would occur and reduce binding of the labeled antibody. In a test assay, a significant reduction in labeled antibody reactivity in the presence of a test antibody is indicative of a test antibody that recognizes substantially the same epitope, i.e., one that competes with the labeled control antibody. For example, any test antibody that reduces the binding of the control antibody to HGF s by at least about 50%, such as at least about 60%, or more preferably at least about 70% (e.g., about 65-100%), at any ratio of test antibody between about 1:1 or 1:10 and about 1:100 is considered to be an antibody that binds to substantially the same or overlapping epitope or determinant as the control antibody.

Preferably, such test antibody will reduce the binding of the control antibody to HGF antigen preferably at least about 50%, at least about 60%, at least about 80% or at least about 90% (e.g., about 95%) of the binding of 1 the control antibody observed in the absence of the test antibody.

Competition can also or alternatively be assessed by, for example, a flow cytometry test. In such a test, cells bearing HGF can be incubated first with a control antibody that binds HGF, and then with the test antibody labeled with a fluorochrome or biotin. The antibody is said to compete with control antibody if the binding obtained upon preincubation with saturating amount of control antibody is about 80%, preferably about 50%, about 40% or less (e.g., about 30%) of the binding (as measured by mean of fluorescence) obtained by the test antibody without preincubation with control antibody. Alternatively, an antibody is said to compete with the control antibody if the binding obtained with a labeled control antibody (by a fluorochrome or biotin) on cells preincubated with saturating amount of test antibody is about 80%, preferably about 50%, about 40%, or less (e.g., about 30%) of the binding obtained without preincubation with the test antibody.

A simple competition assay in which a test antibody is pre-adsorbed and applied at saturating concentration to a surface onto which HGF is immobilized also may be advantageously employed. The surface in the simple competition assay is preferably a BIACORE chip (or other media suitable for surface plasmon resonance analysis). The binding of a control antibody that binds HGF to the HGF-coated surface is measured. This binding to the HGF-containing surface of the control antibody alone is compared with the binding of the control antibody in the presence of a test antibody. A significant reduction in binding to the HGF-containing surface by the control antibody in the presence of a test antibody indicates that the test antibody recognizes substantially the same epitope as the control antibody such that the test antibody "competes" with the control antibody. Any test antibody that reduces the binding of control antibody by at least about 20% or more, at least about 40%, at least about 50%, at least about 70%, or more, can be considered to be an antibody that binds to substantially the same epitope or determinant as the control antibody. Preferably, such test antibody will reduce the binding of the control antibody to HGF by at least about 50% (e.g., at least about 60%, at least about 70%, or more). It will be appreciated that the order of control and test antibodies can be reversed; i.e. The control antibody can be first bound to the surface and then the test antibody is brought into contact with the surface thereafter in a competition assay. Preferably, the antibody having higher affinity for HGF antigen is bound to the HGF-containing surface first, as it will be expected that the decrease in binding seen for the second antibody (assuming the antibodies are competing) will be of greater magnitude. Further examples of such assays are provided in e.g., Saunal and Regenmortel, (1995) J. Immunol. Methods 183: 33-41, the disclosure of which is incorporated herein by reference.

In addition, whether an antibody binds the same or overlapping epitope(s) on HGF as another antibody or the epitope bound by a test antibody may in particular be determined using a western-blot based assay. In this assay a library of peptides corresponding to the antigen bound by the antibody, herein HGF is made, which correspond to overlapping portions of the protein, typically 10-25, 10-20 or 10-15 amino acids long. These different overlapping amino acid peptides encompassing the HGF sequence are synthesized and covalently bound to a PepSpots nitrocellulose membrane (JPT Peptide technologies, Berlin, Germany). Blots are then prepared and probed according to the manufacturer's recommendations.

Essentially, the immunoblot assay then detects by fluorimetric means what peptides in the library bind to the test antibody and thereby can identify what residues on the antigen, i.e., HGF, interact with the test antibody. (See an embodiment of this technique in U.S. Pat. No. 7,935,340, incorporated by reference herein).

The expressions "framework region" or "FR" refer to one or more of the framework regions within the variable regions of the light and heavy chains of an antibody (See Kabat, E. A. et al., Sequences of Proteins of Immunological Interest, National Institutes of Health, Bethesda, Md., (1987)). These expressions include those amino acid sequence regions interposed between the CDRs within the variable regions of the light and heavy chains of an antibody.

Anti-HGF Antibodies and Binding Fragments Thereof

Antibody Ab1

In one embodiment, the invention includes antibodies and antibody fragments having binding specificity to HGF that possess a heavy chain sequence comprising the sequence set forth below:

(SEQ ID NO: 1)
QSVEESGGRLVTPGTPLTLTCTVSGFSLSAYAMSWVRQAPEKGLEWIAVI

YVIGATDYASWAKGRFTISRTSTTVDLRIPSPTTEDTATYFCARVYDSVW

NHFNLWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 2)
QSVEESGGRLVTPGTPLTLTCTVSGFSLSAYAMSWVRQAPEKGLEWIAVI

YVIGATDYASWAKGRFTISRTSTTVDLRIPSPTTEDTATYFCARVYDSVW

NHFNLWGPGTLVTVSS.

In another embodiment, the invention includes antibodies and antibody fragments having binding specificity to HGF that possess the same epitopic specificity as Ab1 and which contain a constant heavy chain sequence comprising the sequence set forth below:

(SEQ ID NO: 10)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 21)
AYDMTQTPASVEVAVGGTVTIKCQASQSISSWLAWYQQKPGQPPKLLIYQ

ASKLASGVPSRFKGSGSGTEFTLTISGVECADAATYYCQQAYSVSNVDNA

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 22)
AYDMTQTPASVEVAVGGTVTIKCQASQSISSWLAWYQQKPGQPPKLLIYQ

ASKLASGVPSRFKGSGSGTEFTLTISGVECADAATYYCQQAYSVSNVDNA

FGGGTEVVVKR.

In another embodiment, the invention includes antibodies and antibody fragments having binding specificity to HGF that bind the same epitope as Ab1 which contain a constant light chain sequence comprising the sequence set forth below:

(SEQ ID NO: 30)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 4; SEQ ID NO: 6; and SEQ ID NO: 8 which correspond to the complementarity-determining regions (CDRs, or hypervariable regions) of the heavy chain sequence of SEQ ID NO: 1 or which contain the variable heavy chain sequence of SEQ ID NO: 2, and/or which further contain one, two, or three of the polypeptide sequences of SEQ ID NO: 24; SEQ ID NO: 26; and SEQ ID NO: 28 which correspond to the complementarity-determining regions (CDRs, or hypervariable regions) of the light chain sequence of SEQ ID NO: 21 or which contain the variable light chain sequence of SEQ ID NO: 22, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 3; SEQ ID NO: 5; SEQ ID NO: 7; and SEQ ID NO: 9 which correspond to the framework regions (FRs or constant regions) of the heavy chain sequence of SEQ ID NO: 1 or the variable heavy chain sequence of SEQ ID NO: 2, and/or one, two, three, or four of the polypeptide sequences of SEQ ID NO: 23; SEQ ID NO: 25; SEQ ID NO: 27; and SEQ ID NO: 29 which correspond to the framework regions (FRs or constant regions) of the light chain sequence of SEQ ID NO: 21 or the variable light chain sequence of SEQ ID NO: 22, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO:

1 or SEQ ID NO: 2 or polypeptides that are at least 90% or 95% identical thereto. In another embodiment of the invention, antibody fragments of the invention comprise, or alternatively consist of, the polypeptide sequence of SEQ ID NO: 21 or SEQ ID NO: 22 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 4; SEQ ID NO: 6; and SEQ ID NO: 8 which correspond to the complementarity-determining regions (CDRs, or hypervariable regions) of the heavy chain sequence of SEQ ID NO: 1 or the variable heavy chain sequence of SEQ ID NO: 2 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 24; SEQ ID NO: 26; and SEQ ID NO: 28 which correspond to the complementarity-determining regions (CDRs, or hypervariable regions) of the light chain sequence of SEQ ID NO: 21 or the variable light chain sequence of SEQ ID NO: 22 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 3; SEQ ID NO: 5; SEQ ID NO: 7; and SEQ ID NO: 9 which correspond to the framework regions (FRs or constant regions) of the heavy chain sequence of SEQ ID NO: 1 or the variable heavy chain sequence of SEQ ID NO: 2 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 23; SEQ ID NO: 25; SEQ ID NO: 27; and SEQ ID NO: 29 which correspond to the framework regions (FRs or constant regions) of the light chain sequence of SEQ ID NO: 21 or the variable light chain sequence of SEQ ID NO: 22 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 2; the variable light chain region of SEQ ID NO: 22; the complementarity-determining regions (SEQ ID NO: 4; SEQ ID NO: 6; and SEQ ID NO: 8) of the variable heavy chain region of SEQ ID NO: 2; and the complementarity-determining regions (SEQ ID NO: 24; SEQ ID NO: 26; and SEQ ID NO: 28) of the variable light chain region of SEQ ID NO: 22 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 2; the variable light chain region of SEQ ID NO: 22; the framework regions (SEQ ID NO: 3; SEQ ID NO: 5; SEQ ID NO: 7; and SEQ ID NO: 9) of the variable heavy chain region of SEQ ID NO: 2; and the framework regions (SEQ ID NO: 23; SEQ ID NO: 25; SEQ ID NO: 27; and SEQ ID NO: 29) of the variable light chain region of SEQ ID NO: 22.

In a particularly preferred embodiment of the invention, the anti-HGF antibody is Ab1, comprising, or alternatively consisting of, SEQ ID NO: 1 and SEQ ID NO: 21, or an antibody or antibody fragment comprising the CDRs of Ab1 and having at least one of the biological activities set forth herein or is an anti-HGF antibody that competes with Ab1 in binding HGF, preferably one containing sequences that are at least 90% or 95% identical to that of Ab1 or an antibody that binds to the same or overlapping epitope(s) on HGF as Ab1.

In a further particularly preferred embodiment of the invention, antibody fragments comprise, or alternatively consist of, Fab (fragment antigen binding) fragments having binding specificity for HGF. With respect to antibody Ab1, the Fab fragment preferably includes the variable heavy chain sequence of SEQ ID NO: 2 and the variable light chain sequence of SEQ ID NO: 22 or sequences that are at least 90% or 95% identical thereto. This embodiment of the invention further includes Fabs containing additions, deletions, and variants of SEQ ID NO: 2 and/or SEQ ID NO: 22 which retain the binding specificity for HGF.

In one embodiment of the invention described herein (infra), Fab fragments may be produced by enzymatic digestion (e.g., papain) of Ab1. In another embodiment of the invention, anti-HGF antibodies such as Ab1 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab1 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab2

In one embodiment, the invention includes antibodies and antibody fragments having binding specificity to HGF that possess a heavy chain sequence comprising the sequence set forth below:

```
                                              (SEQ ID NO: 41)
EVQLVESGGGLVQPGGSLRLSCAASGFTVSAYAMSWVRQAPGKGLEWVAV

IYVIGATDYASSAKGRFTISRDNSKNTLYLQMNSLRAEDTAVYYCARVYD

SVWNHFNLWGQGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

(SEQ ID NO: 42)
EVQLVESGGGLVQPGGSLRLSCAASGFTVSAYAMSWVRQAPGKGLEWVAV

IYVIGATDYASSAKGRFTISRDNSKNTLYLQMNSLRAEDTAVYYCARVYD

SVWNHFNLWGQGTLVTVSS.

In another embodiment, the invention includes antibodies and antibody fragments having binding specificity to HGF that possess the same epitopic specificity as Ab2 and which contain a constant heavy chain sequence comprising the sequence set forth below:

(SEQ ID NO: 50)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 61)
DIQMTQSPSTLSASVGDRVTITCQASQSISSWLAWYQQKPGKAPKLLIYQ

ASKLASGVPSRFSGSGSGTEFTLTISSLQPDDFATYYCQQAYSVSNVDNA

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 62)
DIQMTQSPSTLSASVGDRVTITCQASQSISSWLAWYQQKPGKAPKLLIYQ

ASKLASGVPSRFSGSGSGTEFTLTISSLQPDDFATYYCQQAYSVSNVDNA

FGGGTKVEIKR.

In another embodiment, the invention includes antibodies and antibody fragments having binding specificity to HGF that bind the same epitope as Ab2 which contain a constant light chain sequence comprising the sequence set forth below:

(SEQ ID NO: 70)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 44; SEQ ID NO: 46; and SEQ ID NO: 48 which correspond to the complementarity-determining regions (CDRs, or hypervariable regions) of the heavy chain sequence of SEQ ID NO: 41 or which contain the variable heavy chain sequence of SEQ ID NO: 42, and/or which further contain one, two, or three of the polypeptide sequences of SEQ ID NO: 64; SEQ ID NO: 66; and SEQ ID NO: 68 which correspond to the complementarity-determining regions (CDRs, or hypervariable regions) of the light chain sequence of SEQ ID NO: 61 or which contain the variable light chain sequence of SEQ ID NO: 62, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 43; SEQ ID NO: 45; SEQ ID NO: 47; and SEQ ID NO: 49 which correspond to the framework regions (FRs or constant regions) of the heavy chain sequence of SEQ ID NO: 41 or the variable heavy chain sequence of SEQ ID NO: 42, and/or one, two, three, or four of the polypeptide sequences of SEQ ID NO: 63; SEQ ID NO: 65; SEQ ID NO: 67; and SEQ ID NO: 69 which correspond to the framework regions (FRs or constant regions) of the light chain sequence of SEQ ID NO: 61 or the variable light chain sequence of SEQ ID NO: 62, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 41 or SEQ ID NO: 42 or polypeptides that are at least 90% or 95% identical thereto. In another embodiment of the invention, antibody fragments of the invention comprise, or alternatively consist of, the polypeptide sequence of SEQ ID NO: 61 or SEQ ID NO: 62 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 44; SEQ ID NO: 46; and SEQ ID NO: 48 which correspond to the complementarity-determining regions (CDRs, or hypervariable regions) of the heavy chain sequence of SEQ ID NO: 41 or the variable heavy chain sequence of SEQ ID NO: 42 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 64; SEQ ID NO: 66; and SEQ ID NO: 68 which correspond to the complementarity-determining regions (CDRs, or hypervariable regions) of the light chain sequence of SEQ ID NO: 61 or the variable light chain sequence of SEQ ID NO: 62 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 43; SEQ ID NO: 45; SEQ ID NO: 47; and SEQ ID NO: 49 which correspond to the framework regions (FRs or constant regions) of the heavy chain sequence of SEQ ID NO: 41 or the variable heavy chain sequence of SEQ ID NO: 42 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 63; SEQ ID NO: 65; SEQ ID NO: 67; and SEQ ID NO: 69 which correspond to the framework regions (FRs or constant regions) of the light chain sequence of SEQ ID NO: 61 or the variable light chain sequence of SEQ ID NO: 62 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 42; the variable light chain region of SEQ ID NO: 62; the complementarity-determining regions (SEQ ID NO: 44; SEQ ID NO: 46; and SEQ ID NO: 48) of the variable heavy chain region of SEQ ID NO: 42; and the complementarity-determining regions (SEQ ID NO: 64; SEQ ID NO: 66; and SEQ ID NO: 68) of the variable light chain region of SEQ ID NO: 62 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 42; the variable light chain region of SEQ ID NO: 62; the framework regions (SEQ ID NO: 43; SEQ ID NO: 45; SEQ ID NO: 47; and SEQ ID NO: 49) of the variable heavy chain region of SEQ ID NO: 42; and the framework regions (SEQ ID NO: 63; SEQ ID NO: 65; SEQ ID NO: 67; and SEQ ID NO: 69) of the variable light chain region of SEQ ID NO: 62.

In a particularly preferred embodiment of the invention, the anti-HGF antibody is Ab2, comprising, or alternatively consisting of, SEQ ID NO: 41 and SEQ ID NO: 61, or an antibody or antibody fragment comprising the CDRs of Ab2 and having at least one of the biological activities set forth herein or is an anti-HGF antibody that competes with Ab2 in binding HGF, preferably one containing sequences that are at least 90% or 95% identical to that of Ab2 or an antibody that binds to the same or overlapping epitope(s) on HGF as Ab2.

In a further particularly preferred embodiment of the invention, antibody fragments comprise, or alternatively consist of, Fab (fragment antigen binding) fragments having binding specificity for HGF. With respect to antibody Ab2, the Fab fragment preferably includes the variable heavy chain sequence of SEQ ID NO: 42 and the variable light chain sequence of SEQ ID NO: 62 or sequences that are at least 90% or 95% identical thereto. This embodiment of the invention further includes Fabs containing additions, deletions, and variants of SEQ ID NO: 42 and/or SEQ ID NO: 62 which retain the binding specificity for HGF.

In one embodiment of the invention described herein (infra), Fab fragments may be produced by enzymatic digestion (e.g., papain) of Ab2. In another embodiment of the invention, anti-HGF antibodies such as Ab2 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab2 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab3

In one embodiment, the invention includes antibodies and antibody fragments having binding specificity to HGF that possess a heavy chain sequence comprising the sequence set forth below:

(SEQ ID NO: 81)
QSVEESGGRLVTPGTPLTLTCTVSGLTISSYYMSWVRQAPGKGLEWIGTI

NPGANTYFASWAKGRFTISRTSTTVDLKITSPTTEDTATYFCAREGDSND

WGVFDLWGQGTLVTVSSASTKGPSVFPLAPSSKSTSGGTAALGCLVKDYF

PEPVTVSWNSGALTSGVHTFPAVLQSSGLYSLSSVVTVPSSSLGTQTYIC

NVNHKPSNTKVDKRVEPKSCDKTHTCPPCPAPELLGGPSVFLFPPKPKDT

LMISRTPEVTCVVVDVSHEDPEVKFNWYVDGVEVHNAKTKPREEQYASTY

RVVSVLTVLHQDWLNGKEYKCKVSNKALPAPIEKTISKAKGQPREPQVYT

LPPSREEMTKNQVSLTCLVKGFYPSDIAVEWESNGQPENNYKTTPPVLDS

DGSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 82)
QSVEESGGRLVTPGTPLTLTCTVSGLTISSYYMSWVRQAPGKGLEWIGTI

NPGANTYFASWAKGRFTISRTSTTVDLKITSPTTEDTATYFCAREGDSND

WGVFDLWGQGTLVTVSS.

In another embodiment, the invention includes antibodies and antibody fragments having binding specificity to HGF that possess the same epitopic specificity as Ab3 and which contain a constant heavy chain sequence comprising the sequence set forth below:

(SEQ ID NO: 90)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 101)
AYDMTQTPASVEIAVGGTVTIRCQASEDIESYLAWYQQKPGQPPKLLIYR

ASDLASGVSSRFKGSGSGTDYTLTISGVECDDAATYYCQQGYTIDNVDNT

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 102)
AYDMTQTPASVEIAVGGTVTIRCQASEDIESYLAWYQQKPGQPPKLLIYR

ASDLASGVSSRFKGSGSGTDYTLTISGVECDDAATYYCQQGYTIDNVDNT

FGGGTEVVVKR.

In another embodiment, the invention includes antibodies and antibody fragments having binding specificity to HGF that bind the same epitope as Ab3 which contain a constant light chain sequence comprising the sequence set forth below:

(SEQ ID NO: 110)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 84; SEQ ID NO: 86; and SEQ ID NO: 88 which correspond to the complementarity-determining regions (CDRs, or hypervariable regions) of the heavy chain sequence of SEQ ID NO: 81 or which contain the variable heavy chain sequence of SEQ ID NO: 82, and/or which further contain one, two, or three of the polypeptide sequences of SEQ ID NO: 104; SEQ ID NO: 106; and SEQ ID NO: 108 which correspond to the complementarity-determining regions (CDRs, or hypervariable regions) of the light chain sequence of SEQ ID NO: 101 or which contain the variable light chain sequence of SEQ ID NO: 102, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 83; SEQ ID NO: 85; SEQ ID NO: 87; and SEQ ID NO: 89 which correspond to the framework regions (FRs or constant regions) of the heavy chain sequence of SEQ ID NO: 81 or the variable heavy chain sequence of SEQ ID NO: 82, and/or one, two, three, or four of the polypeptide sequences of SEQ ID NO: 103; SEQ ID NO: 105; SEQ ID NO: 107; and SEQ ID NO: 109 which correspond to the framework regions (FRs or constant regions) of the light chain sequence of SEQ ID NO: 101 or the variable light chain sequence of SEQ ID NO: 102, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 81 or SEQ ID NO: 82 or polypeptides that are at least 90% or 95% identical thereto. In another embodiment of the invention, antibody fragments of the invention comprise, or alternatively consist of, the polypeptide sequence of SEQ ID NO: 101 or SEQ ID NO: 102 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 84; SEQ ID NO: 86; and SEQ ID NO: 88 which correspond to the complementarity-determining regions (CDRs, or hypervariable regions) of the heavy chain sequence of SEQ ID NO: 81 or the variable heavy chain sequence of SEQ ID NO: 82 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 104; SEQ ID NO: 106; and SEQ ID NO: 108 which correspond to the complementarity-determining regions (CDRs, or hypervariable regions) of the light chain sequence of SEQ ID NO: 101 or the variable light chain sequence of SEQ ID NO: 102 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 83; SEQ ID NO: 85; SEQ ID NO: 87; and SEQ ID NO: 89 which correspond to the framework regions (FRs or constant regions) of the heavy chain sequence of SEQ ID NO: 81 or the variable heavy chain sequence of SEQ ID NO: 82 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 103; SEQ ID NO: 105; SEQ ID NO: 107; and SEQ ID NO: 109 which correspond to the framework regions (FRs or constant regions) of the light chain sequence of SEQ ID NO: 101 or the variable light chain sequence of SEQ ID NO: 102 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 82; the variable light chain region of SEQ ID NO: 102; the complementarity-determining regions (SEQ ID NO: 84; SEQ ID NO: 86; and SEQ ID NO: 88) of the variable heavy chain region of SEQ ID NO: 82; and the complementarity-determining regions (SEQ ID NO: 104; SEQ ID NO: 106; and SEQ ID NO: 108) of the variable light chain region of SEQ ID NO: 102 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 82; the variable light chain region of SEQ ID NO: 102; the framework regions (SEQ ID NO: 83; SEQ ID NO: 85; SEQ ID NO: 87; and SEQ ID NO: 89) of the variable heavy chain region of SEQ ID NO: 82; and the framework regions (SEQ ID NO: 103; SEQ ID NO: 105; SEQ ID NO: 107; and SEQ ID NO: 109) of the variable light chain region of SEQ ID NO: 102.

In a particularly preferred embodiment of the invention, the anti-HGF antibody is Ab3, comprising, or alternatively consisting of, SEQ ID NO: 81 and SEQ ID NO: 101, or an antibody or antibody fragment comprising the CDRs of Ab3 and having at least one of the biological activities set forth herein or is an anti-HGF antibody that competes with Ab3 in binding HGF, preferably one containing sequences that are at least 90% or 95% identical to that of Ab3 or an antibody that binds to the same or overlapping epitope(s) on HGF as Ab3.

In a further particularly preferred embodiment of the invention, antibody fragments comprise, or alternatively consist of, Fab (fragment antigen binding) fragments having binding specificity for HGF. With respect to antibody Ab3, the Fab fragment preferably includes the variable heavy chain sequence of SEQ ID NO: 82 and the variable light chain sequence of SEQ ID NO: 102 or sequences that are at least 90% or 95% identical thereto. This embodiment of the invention further includes Fabs containing additions, deletions, and variants of SEQ ID NO: 82 and/or SEQ ID NO: 102 which retain the binding specificity for HGF.

In one embodiment of the invention described herein (infra), Fab fragments may be produced by enzymatic digestion (e.g., papain) of Ab3. In another embodiment of the invention, anti-HGF antibodies such as Ab3 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab3 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab4

In one embodiment, the invention includes antibodies and antibody fragments having binding specificity to HGF that possess a heavy chain sequence comprising the sequence set forth below:

```
                                         (SEQ ID NO: 121)
QSLEESGGRLVQPGTPLTLSCTASGLTISSYYMSWVRQAPGKGLEWVGTI

NPGANTYFASSAKGRFTISRSSTTLDLKMTSPTAEDTATYYCAREGDSND

WGVFDLWGQGTLVTVSSASTKGPSVFPLAPSSKSTSGGTAALGCLVKDYF

PEPVTVSWNSGALTSGVHTFPAVLQSSGLYSLSSVVTVPSSSLGTQTYIC

NVNHKPSNTKVDKRVEPKSCDKTHTCPPCPAPELLGGPSVFLFPPKPKDT

LMISRTPEVTCVVVDVSHEDPEVKFNWYVDGVEVHNAKTKPREEQYASTY

RVVSVLTVLHQDWLNGKEYKCKVSNKALPAPIEKTISKAKGQPREPQVYT

LPPSREEMTKNQVSLTCLVKGFYPSDIAVEWESNGQPENNYKTTPPVLDS

DGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                         (SEQ ID NO: 122)
QSLEESGGRLVQPGTPLTLSCTASGLTISSYYMSWVRQAPGKGLEWVGTI

NPGANTYFASSAKGRFTISRSSTTLDLKMTSPTAEDTATYYCAREGDSND

WGVFDLWGQGTLVTVSS.
```

In another embodiment, the invention includes antibodies and antibody fragments having binding specificity to HGF that possess the same epitopic specificity as Ab4 and which contain a constant heavy chain sequence comprising the sequence set forth below:

```
                                         (SEQ ID NO: 130)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

(SEQ ID NO: 141)
AYDMTQSPASVEAAVGGTVTIRCQASEDIESYLAWYQQKPGQPPKLLIYR

ASDLASGVSSRFKGSGSGTDYTLTISGLEPEDAATYYCQQGYTIDNVDNT

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 142)
AYDMTQSPASVEAAVGGTVTIRCQASEDIESYLAWYQQKPGQPPKLLIYR

ASDLASGVSSRFKGSGSGTDYTLTISGLEPEDAATYYCQQGYTIDNVDNT

FGGGTKVEIKR.

In another embodiment, the invention includes antibodies and antibody fragments having binding specificity to HGF that bind the same epitope as Ab4 which contain a constant light chain sequence comprising the sequence set forth below:

(SEQ ID NO: 150)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 124; SEQ ID NO: 126; and SEQ ID NO: 128 which correspond to the complementarity-determining regions (CDRs, or hypervariable regions) of the heavy chain sequence of SEQ ID NO: 121 or which contain the variable heavy chain sequence of SEQ ID NO: 122, and/or which further contain one, two, or three of the polypeptide sequences of SEQ ID NO: 144; SEQ ID NO: 146; and SEQ ID NO: 148 which correspond to the complementarity-determining regions (CDRs, or hypervariable regions) of the light chain sequence of SEQ ID NO: 141 or which contain the variable light chain sequence of SEQ ID NO: 142, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 123; SEQ ID NO: 125; SEQ ID NO: 127; and SEQ ID NO: 129 which correspond to the framework regions (FRs or constant regions) of the heavy chain sequence of SEQ ID NO: 121 or the variable heavy chain sequence of SEQ ID NO: 122, and/or one, two, three, or four of the polypeptide sequences of SEQ ID NO: 143; SEQ ID NO: 145; SEQ ID NO: 147; and SEQ ID NO: 149 which correspond to the framework regions (FRs or constant regions) of the light chain sequence of SEQ ID NO: 141 or the variable light chain sequence of SEQ ID NO: 142, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 121 or SEQ ID NO: 122 or polypeptides that are at least 90% or 95% identical thereto. In another embodiment of the invention, antibody fragments of the invention comprise, or alternatively consist of, the polypeptide sequence of SEQ ID NO: 141 or SEQ ID NO: 142 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 124; SEQ ID NO: 126; and SEQ ID NO: 128 which correspond to the complementarity-determining regions (CDRs, or hypervariable regions) of the heavy chain sequence of SEQ ID NO: 121 or the variable heavy chain sequence of SEQ ID NO: 122 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 144; SEQ ID NO: 146; and SEQ ID NO: 148 which correspond to the complementarity-determining regions (CDRs, or hypervariable regions) of the light chain sequence of SEQ ID NO: 141 or the variable light chain sequence of SEQ ID NO: 142 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 123; SEQ ID NO: 125; SEQ ID NO: 127; and SEQ ID NO: 129 which correspond to the framework regions (FRs or constant regions) of the heavy chain sequence of SEQ ID NO: 121 or the variable heavy chain sequence of SEQ ID NO: 122 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 143; SEQ ID NO: 145; SEQ ID NO: 147; and SEQ ID NO: 149 which correspond to the framework regions (FRs or constant regions) of the light chain sequence of SEQ ID NO: 141 or the variable light chain sequence of SEQ ID NO: 142 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 122; the variable light chain region of SEQ ID NO: 142; the complementarity-determining regions (SEQ ID NO: 124; SEQ ID NO: 126; and SEQ ID NO: 128) of the variable heavy chain region of SEQ ID NO: 122; and the complementarity-determining regions (SEQ ID NO: 144; SEQ ID NO: 146; and SEQ ID NO: 148) of the variable light chain region of SEQ ID NO: 142 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 122; the variable light chain region of SEQ ID NO: 142; the framework regions (SEQ ID NO: 123; SEQ ID NO: 125; SEQ ID NO: 127; and SEQ ID NO: 129) of the variable heavy chain region of SEQ ID NO: 122; and the framework regions (SEQ ID NO: 143; SEQ ID NO: 145; SEQ ID NO: 147; and SEQ ID NO: 149) of the variable light chain region of SEQ ID NO: 142.

In a particularly preferred embodiment of the invention, the anti-HGF antibody is Ab4, comprising, or alternatively consisting of, SEQ ID NO: 121 and SEQ ID NO: 141, or an antibody or antibody fragment comprising the CDRs of Ab4 and having at least one of the biological activities set forth herein or is an anti-HGF antibody that competes with Ab4 in binding HGF, preferably one containing sequences that are at least 90% or 95% identical to that of Ab4 or an antibody that binds to the same or overlapping epitope(s) on HGF as Ab4.

In a further particularly preferred embodiment of the invention, antibody fragments comprise, or alternatively consist of, Fab (fragment antigen binding) fragments having binding specificity for HGF. With respect to antibody Ab4, the Fab fragment preferably includes the variable heavy chain sequence of SEQ ID NO: 122 and the variable light chain sequence of SEQ ID NO: 142 or sequences that are at least 90% or 95% identical thereto. This embodiment of the invention further includes Fabs containing additions, deletions, and variants of SEQ ID NO: 122 and/or SEQ ID NO: 142 which retain the binding specificity for HGF.

In one embodiment of the invention described herein (infra), Fab fragments may be produced by enzymatic digestion (e.g., papain) of Ab4. In another embodiment of the invention, anti-HGF antibodies such as Ab4 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab4 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab5

In one embodiment, the invention includes antibodies and antibody fragments having binding specificity to HGF that possess a heavy chain sequence comprising the sequence set forth below:

```
                                        (SEQ ID NO: 161)
QSLEESGGRLVTPGTPLTLTCTVSGFSLNNYAVGWVRQAPGKGLEWIGII

YLSGNTDYANWAKGRFTISKTSTTVDLKITSPTTEDTATYFCARKFDTGY

DIWGPGTLVTVSSASTKGPSVFPLAPSSKSTSGGTAALGCLVKDYFPEPV

TVSWNSGALTSGVHTFPAVLQSSGLYSLSSVVTVPSSSLGTQTYICNVNH

KPSNTKVDKRVEPKSCDKTHTCPPCPAPELLGGPSVFLFPPKPKDTLMIS

RTPEVTCVVVDVSHEDPEVKFNWYVDGVEVHNAKTKPREEQYASTYRVVS

VLTVLHQDWLNGKEYKCKVSNKALPAPIEKTISKAKGQPREPQVYTLPPS

REEMTKNQVSLTCLVKGFYPSDIAVEWESNGQPENNYKTTPPVLDSDGSF

FLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                        (SEQ ID NO: 162)
QSLEESGGRLVTPGTPLTLTCTVSGFSLNNYAVGWVRQAPGKGLEWIGII

YLSGNTDYANWAKGRFTISKTSTTVDLKITSPTTEDTATYFCARKFDTGY

DIWGPGTLVTVSS.
```

In another embodiment, the invention includes antibodies and antibody fragments having binding specificity to HGF that possess the same epitopic specificity as Ab5 and which contain a constant heavy chain sequence comprising the sequence set forth below:

```
                                        (SEQ ID NO: 170)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                        (SEQ ID NO: 181)
AYDMTQTPASMEVAVGGTVTIKCQASQSISTYLAWYQQKPGQPPKLLIYD

ASDLASGVSSRFKGSGSGTQFTLTISGVECDDAATYYCQQDWSDSNVDNA

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to HGF that contain a variable light chain sequence comprising the sequence set forth below:

(SEQ ID NO: 182)
AYDMTQTPASMEVAVGGTVTIKCQASQSISTYLAWYQQKPGQPPKLLIYD

ASDLASGVSSRFKGSGSGTQFTLTISGVECDDAATYYCQQDWSDSNVDNA

FGGGTEVVVKR.

In another embodiment, the invention includes antibodies and antibody fragments having binding specificity to HGF that bind the same epitope as Ab5 which contain a constant light chain sequence comprising the sequence set forth below:

(SEQ ID NO: 190)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 164; SEQ ID NO: 166; and SEQ ID NO: 168 which correspond to the complementarity-determining regions (CDRs, or hypervariable regions) of the heavy chain sequence of SEQ ID NO: 161 or which contain the variable heavy chain sequence of SEQ ID NO: 162, and/or which further contain one, two, or three of the polypeptide sequences of SEQ ID NO: 184; SEQ ID NO: 186; and SEQ ID NO: 188 which correspond to the complementarity-determining regions (CDRs, or hypervariable regions) of the light chain sequence of SEQ ID NO: 181 or which contain the variable light chain sequence of SEQ ID NO: 182, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 163; SEQ ID NO: 165; SEQ ID NO: 167; and SEQ ID NO: 169 which correspond to the framework regions (FRs or constant regions) of the heavy chain sequence of SEQ ID NO: 161 or the variable heavy chain sequence of SEQ ID NO: 162, and/or one, two, three, or four of the polypeptide sequences of SEQ ID NO: 183; SEQ ID NO: 185; SEQ ID NO: 187; and SEQ ID NO: 189 which correspond to the framework regions (FRs or constant regions) of the light chain sequence of SEQ ID NO: 181 or the variable light chain sequence of SEQ ID NO: 182, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 161 or SEQ ID NO: 162 or polypeptides that are at least 90% or 95% identical thereto. In another embodiment of the invention, antibody fragments of the invention comprise, or alternatively consist of, the polypeptide sequence of SEQ ID NO: 181 or SEQ ID NO: 182 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 164; SEQ ID NO: 166; and SEQ ID NO: 168 which correspond to the complementarity-determining regions (CDRs, or hypervariable regions) of the heavy chain sequence of SEQ ID NO: 161 or the variable heavy chain sequence of SEQ ID NO: 162 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 184; SEQ ID NO: 186; and SEQ ID NO: 188 which correspond to the complementarity-determining regions (CDRs, or hypervariable regions) of the light chain sequence of SEQ ID NO: 181 or the variable light chain sequence of SEQ ID NO: 182 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 163; SEQ ID NO: 165; SEQ ID NO: 167; and SEQ ID NO: 169 which correspond to the framework regions (FRs or constant regions) of the heavy chain sequence of SEQ ID NO: 161 or the variable heavy chain sequence of SEQ ID NO: 162 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 183; SEQ ID NO: 185; SEQ ID NO: 187; and SEQ ID NO: 189 which correspond to the framework regions (FRs or constant regions) of the light chain sequence of SEQ ID NO: 181 or the variable light chain sequence of SEQ ID NO: 182 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 162; the variable light chain region of SEQ ID NO: 182; the complementarity-determining regions (SEQ ID NO: 164; SEQ ID NO: 166; and SEQ ID NO: 168) of the variable heavy chain region of SEQ ID NO: 162; and the complementarity-determining regions (SEQ ID NO: 184; SEQ ID NO: 186; and SEQ ID NO: 188) of the variable light chain region of SEQ ID NO: 182 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 162; the variable light chain region of SEQ ID NO: 182; the framework regions (SEQ ID NO: 163; SEQ ID NO: 165; SEQ ID NO: 167; and SEQ ID NO: 169) of the variable heavy chain region of SEQ ID NO: 162; and the framework regions (SEQ ID NO: 183; SEQ ID NO: 185; SEQ ID NO: 187; and SEQ ID NO: 189) of the variable light chain region of SEQ ID NO: 182.

In a particularly preferred embodiment of the invention, the anti-HGF antibody is Ab5, comprising, or alternatively consisting of, SEQ ID NO: 161 and SEQ ID NO: 181, or an antibody or antibody fragment comprising the CDRs of Ab5 and having at least one of the biological activities set forth herein or is an anti-HGF antibody that competes with Ab5 in binding HGF, preferably one containing sequences that are at least 90% or 95% identical to that of Ab5 or an antibody that binds to the same or overlapping epitope(s) on HGF as Ab5.

In a further particularly preferred embodiment of the invention, antibody fragments comprise, or alternatively consist of, Fab (fragment antigen binding) fragments having binding specificity for HGF. With respect to antibody Ab5, the Fab fragment preferably includes the variable heavy chain sequence of SEQ ID NO: 162 and the variable light chain sequence of SEQ ID NO: 182 or sequences that are at least 90% or 95% identical thereto. This embodiment of the invention further includes Fabs containing additions, deletions, and variants of SEQ ID NO: 162 and/or SEQ ID NO: 182 which retain the binding specificity for HGF.

In one embodiment of the invention described herein (infra), Fab fragments may be produced by enzymatic digestion (e.g., papain) of Ab5. In another embodiment of the invention, anti-HGF antibodies such as Ab5 or Fab fragments thereof may be produced via expression in mammalian cells such as CHO, NS0 or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab5 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab6

In one embodiment, the invention includes antibodies and antibody fragments having binding specificity to HGF that possess a heavy chain sequence comprising the sequence set forth below:

(SEQ ID NO: 201)
QSVEESGGRLVMPGTPLTLTCTVSGFSLSSNAISWVRQAPEKGLEWIGVI

YVIGVTDYASWAQGRFTISKTSTTVDLKIPSPTTEDTATYFCARVYDSGW

NHFNLWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

-continued
VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 202)
QSVEESGGRLVMPGTPLTLTCTVSGFSLSSNAISWVRQAPEKGLEWIGVI

YVIGVTDYASWAQGRFTISKTSTTVDLKIPSPTTEDTATYFCARVYDSGW

NHFNLWGPGTLVTVSS.

In another embodiment, the invention includes antibodies and antibody fragments having binding specificity to HGF that possess the same epitopic specificity as Ab6 and which contain a constant heavy chain sequence comprising the sequence set forth below:

(SEQ ID NO: 210)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 221)
ADIVMTQTPSSVEAAVGGTVTIKCQASENIYRLLAWYQQKPGQRPKLLIY

SASTLASGVPSRFKGSGSGTQFTLTISDLECADAATYYCQNYYYSSRSSY

DTYNVFGGGTEVVVKRTVAAPSVFIFPPSDEQLKSGTASVVCLLNNFYPR

EAKVQWKVDNALQSGNSQESVTEQDSKDSTYSLSSTLTLSKADYEKHKVY

ACEVTHQGLSSPVTKSFNRGEC.

In another embodiment, the invention includes antibodies and antibody fragments having binding specificity to HGF that contain a variable light chain sequence comprising the sequence set forth below:

(SEQ ID NO: 222)
ADIVMTQTPSSVEAAVGGTVTIKCQASENIYRLLAWYQQKPGQRPKLLIY

SASTLASGVPSRFKGSGSGTQFTLTISDLECADAATYYCQNYYYSSRSSY

DTYNVFGGGTEVVVKR.

In another embodiment, the invention includes antibodies and antibody fragments having binding specificity to HGF that bind the same epitope as Ab6 which contain a constant light chain sequence comprising the sequence set forth below:

(SEQ ID NO: 230)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 204; SEQ ID NO: 206; and SEQ ID NO: 208 which correspond to the complementarity-determining regions (CDRs, or hypervariable regions) of the heavy chain sequence of SEQ ID NO: 201 or which contain the variable heavy chain sequence of SEQ ID NO: 202, and/or which further contain one, two, or three of the polypeptide sequences of SEQ ID NO: 224; SEQ ID NO: 226; and SEQ ID NO: 228 which correspond to the complementarity-determining regions (CDRs, or hypervariable regions) of the light chain sequence of SEQ ID NO: 221 or which contain the variable light chain sequence of SEQ ID NO: 222, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 203; SEQ ID NO: 205; SEQ ID NO: 207; and SEQ ID NO: 209 which correspond to the framework regions (FRs or constant regions) of the heavy chain sequence of SEQ ID NO: 201 or the variable heavy chain sequence of SEQ ID NO: 202, and/or one, two, three, or four of the polypeptide sequences of SEQ ID NO: 223; SEQ ID NO: 225; SEQ ID NO: 227; and SEQ ID NO: 229 which correspond to the framework regions (FRs or constant regions) of the light chain sequence of SEQ ID NO: 221 or the variable light chain sequence of SEQ ID NO: 222, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 201 or SEQ ID NO: 202 or polypeptides that are at least 90% or 95% identical thereto. In another embodiment of the invention, antibody fragments of the invention comprise, or alternatively consist of, the polypeptide sequence of SEQ ID NO: 221 or SEQ ID NO: 222 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 204; SEQ ID NO: 206; and SEQ ID NO: 208 which correspond to the complementarity-determining regions (CDRs, or hypervariable regions) of the heavy chain sequence of SEQ ID NO: 201 or the variable heavy chain sequence of SEQ ID NO: 202 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 224; SEQ ID NO: 226; and SEQ ID NO: 228 which correspond to the complementarity-determining regions (CDRs, or hypervariable regions) of the light chain sequence of SEQ ID NO: 221 or the variable light chain sequence of SEQ ID NO: 222 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 203; SEQ ID NO: 205; SEQ ID NO: 207; and SEQ ID NO: 209 which correspond to the framework regions (FRs or constant regions) of the heavy chain sequence of SEQ ID NO: 201 or the variable heavy chain sequence of SEQ ID NO: 202 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 223; SEQ ID NO: 225; SEQ ID NO: 227; and SEQ ID NO: 229 which correspond to the framework regions (FRs or constant regions) of the light chain sequence of SEQ ID NO: 221 or the variable light chain sequence of SEQ ID NO: 222 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 202; the variable light chain region of SEQ ID NO: 222; the complementarity-determining regions (SEQ ID NO: 204; SEQ ID NO: 206; and SEQ ID NO: 208) of the variable heavy chain region of SEQ ID NO: 202; and the complementarity-determining regions (SEQ ID NO: 224; SEQ ID NO: 226; and SEQ ID NO: 228) of the variable light chain region of SEQ ID NO: 222 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 202; the variable light chain region of SEQ ID NO: 222; the framework regions (SEQ ID NO: 203; SEQ ID NO: 205; SEQ ID NO: 207; and SEQ ID NO: 209) of the variable heavy chain region of SEQ ID NO: 202; and the framework regions (SEQ ID NO: 223; SEQ ID NO: 225; SEQ ID NO: 227; and SEQ ID NO: 229) of the variable light chain region of SEQ ID NO: 222.

In a particularly preferred embodiment of the invention, the anti-HGF antibody is Ab6, comprising, or alternatively consisting of, SEQ ID NO: 201 and SEQ ID NO: 221, or an antibody or antibody fragment comprising the CDRs of Ab6 and having at least one of the biological activities set forth herein or is an anti-HGF antibody that competes with Ab6 in binding HGF, preferably one containing sequences that are at least 90% or 95% identical to that of Ab6 or an antibody that binds to the same or overlapping epitope(s) on HGF as Ab6.

In a further particularly preferred embodiment of the invention, antibody fragments comprise, or alternatively consist of, Fab (fragment antigen binding) fragments having binding specificity for HGF. With respect to antibody Ab6, the Fab fragment preferably includes the variable heavy chain sequence of SEQ ID NO: 202 and the variable light chain sequence of SEQ ID NO: 222 or sequences that are at least 90% or 95% identical thereto. This embodiment of the invention further includes Fabs containing additions, deletions, and variants of SEQ ID NO: 202 and/or SEQ ID NO: 222 which retain the binding specificity for HGF.

In one embodiment of the invention described herein (infra), Fab fragments may be produced by enzymatic digestion (e.g., papain) of Ab6. In another embodiment of the invention, anti-HGF antibodies such as Ab6 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab6 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab7

In one embodiment, the invention includes antibodies and antibody fragments having binding specificity to HGF that possess a heavy chain sequence comprising the sequence set forth below:

```
                                              (SEQ ID NO: 241)
QSVEESGGRLVMPGTPLTLTCTVSGFSLSSNAISWVRQAPEKGLEWIGVI

YVIGVTDYASWAQGRFTISKTSTTVDLKIPSPTTEDTATYFCARVYDSGW

NHFNLWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                              (SEQ ID NO: 242)
QSVEESGGRLVMPGTPLTLTCTVSGFSLSSNAISWVRQAPEKGLEWIGVI

YVIGVTDYASWAQGRFTISKTSTTVDLKIPSPTTEDTATYFCARVYDSGW

NHFNLWGPGTLVTVSS.
```

In another embodiment, the invention includes antibodies and antibody fragments having binding specificity to HGF that possess the same epitopic specificity as Ab7 and which contain a constant heavy chain sequence comprising the sequence set forth below:

```
                                              (SEQ ID NO: 250)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                              (SEQ ID NO: 261)
AYDMTQTPASVEVAVGGTVTIKCQASQSISSWLAWYQQKPGQPPKLLIYE

ASKLASGVPSRFSGSGSGTQFTLTISGVECADAATYYCQQAYSVANVDNA

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to HGF that contain a variable light chain sequence comprising the sequence set forth below:

```
                                              (SEQ ID NO: 262)
AYDMTQTPASVEVAVGGTVTIKCQASQSISSWLAWYQQKPGQPPKLLIYE

ASKLASGVPSRFSGSGSGTQFTLTISGVECADAATYYCQQAYSVANVDNA

FGGGTEVVVKR.
```

In another embodiment, the invention includes antibodies and antibody fragments having binding specificity to HGF that bind the same epitope as Ab7 which contain a constant light chain sequence comprising the sequence set forth below:

```
                                              (SEQ ID NO: 270)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to HGF that contain one, two, or three of the polypeptide sequences of SEQ ID NO: 244; SEQ ID NO: 246; and SEQ ID NO: 248 which correspond to the complementarity-determining regions (CDRs, or hypervariable regions) of the heavy chain sequence of SEQ ID NO: 241 or which contain the variable heavy chain sequence of SEQ ID NO: 242, and/or which further contain one, two, or three of the polypeptide sequences of SEQ ID NO: 264; SEQ ID NO: 266; and SEQ ID NO: 268 which correspond to the complementarity-determining regions (CDRs, or hypervariable regions) of the light chain sequence of SEQ ID NO: 261 or which contain the variable light chain sequence of SEQ ID NO: 262, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 243; SEQ ID NO: 245; SEQ ID NO: 247; and SEQ ID NO: 249 which correspond to the framework regions (FRs or constant regions) of the heavy chain sequence of SEQ ID NO: 241 or the variable heavy chain sequence of SEQ ID NO: 242, and/or one, two, three, or four of the polypeptide sequences of SEQ ID NO: 263; SEQ ID NO: 265; SEQ ID NO: 267; and SEQ ID NO: 269 which correspond to the framework regions (FRs or constant regions) of the light chain sequence of SEQ ID NO: 261 or the variable light chain sequence of SEQ ID NO: 262, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 241 or SEQ ID NO: 242 or polypeptides that are at least 90% or 95% identical thereto. In another embodiment of the invention, antibody fragments of the invention comprise, or alternatively consist of, the polypeptide sequence of SEQ ID NO: 261 or SEQ ID NO: 262 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 244; SEQ ID NO: 246; and SEQ ID NO: 248 which correspond to the complementarity-determining regions (CDRs, or hypervariable regions) of the heavy chain sequence of SEQ ID NO: 241 or the variable heavy chain sequence of SEQ ID NO: 242 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 264; SEQ ID NO: 266; and SEQ ID NO: 268 which correspond to the complementarity-determining regions (CDRs, or hypervariable regions) of the light chain sequence of SEQ ID NO: 261 or the variable light chain sequence of SEQ ID NO: 262 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 243; SEQ ID NO: 245; SEQ ID NO: 247; and SEQ ID NO: 249 which correspond to the framework regions (FRs or constant regions) of the heavy chain sequence of SEQ ID NO: 241 or the variable heavy chain sequence of SEQ ID NO: 242 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 263; SEQ ID NO: 265; SEQ ID NO: 267; and SEQ ID NO: 269 which correspond to the framework regions (FRs or constant regions) of the light chain sequence of SEQ ID NO: 261 or the variable light chain sequence of SEQ ID NO: 262 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 242; the variable light chain region of SEQ ID NO: 262; the complementarity-determining regions (SEQ ID NO: 244; SEQ ID NO: 246; and SEQ ID NO: 248) of the variable heavy chain region of SEQ ID NO: 242; and the complementarity-determining regions (SEQ ID NO: 264; SEQ ID NO: 266; and SEQ ID NO: 268) of the variable light chain region of SEQ ID NO: 262 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 242; the variable light chain region of SEQ ID NO: 262; the framework regions (SEQ ID NO: 243; SEQ ID NO: 245; SEQ ID NO: 247; and SEQ ID NO: 249) of the variable heavy chain region of SEQ ID NO: 242; and the framework regions (SEQ ID NO: 263; SEQ ID NO: 265; SEQ ID NO: 267; and SEQ ID NO: 269) of the variable light chain region of SEQ ID NO: 262.

In a particularly preferred embodiment of the invention, the anti-HGF antibody is Ab7, comprising, or alternatively consisting of, SEQ ID NO: 241 and SEQ ID NO: 261, or an antibody or antibody fragment comprising the CDRs of Ab7 and having at least one of the biological activities set forth herein or is an anti-HGF antibody that competes with Ab7 in binding HGF, preferably one containing sequences that are at least 90% or 95% identical to that of Ab7 or an antibody that binds to the same or overlapping epitope(s) on HGF as Ab7.

In a further particularly preferred embodiment of the invention, antibody fragments comprise, or alternatively consist of, Fab (fragment antigen binding) fragments having binding specificity for HGF. With respect to antibody Ab7, the Fab fragment preferably includes the variable heavy chain sequence of SEQ ID NO: 242 and the variable light chain sequence of SEQ ID NO: 262 or sequences that are at least 90% or 95% identical thereto. This embodiment of the invention further includes Fabs containing additions, deletions, and variants of SEQ ID NO: 242 and/or SEQ ID NO: 262 which retain the binding specificity for HGF.

In one embodiment of the invention described herein (infra), Fab fragments may be produced by enzymatic digestion (e.g., papain) of Ab7. In another embodiment of the invention, anti-HGF antibodies such as Ab7 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab7 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab8

In one embodiment, the invention includes antibodies and antibody fragments having binding specificity to HGF that possess a heavy chain sequence comprising the sequence set forth below:

```
                                        (SEQ ID NO: 281)
EVQLVESGGGLVQPGGSLRLSCAASGFTVSSNAISWVRQAPGKGLEWVGV

IYVIGVTDYASSAQGRFTISRDNSKNTLYLQMNSLRAEDTAVYYCARVYD

SGWNHFNLWGQGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                        (SEQ ID NO: 282)
EVQLVESGGGLVQPGGSLRLSCAASGFTVSSNAISWVRQAPGKGLEWVGV

IYVIGVTDYASSAQGRFTISRDNSKNTLYLQMNSLRAEDTAVYYCARVYD

SGWNHFNLWGQGTLVTVSS.
```

In another embodiment, the invention includes antibodies and antibody fragments having binding specificity to HGF that possess the same epitopic specificity as Ab8 and which contain a constant heavy chain sequence comprising the sequence set forth below:

```
                                        (SEQ ID NO: 290)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                        (SEQ ID NO: 301)
DIQMTQSPSTLSASVGDRVTITCQASQSISSWLAWYQQKPGKAPKLLIYE

ASKLASGVPSRFSGSGSGTEFTLTISSLQPDDFATYYCQQAYSVANVDNA

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to HGF that contain a variable light chain sequence comprising the sequence set forth below:

```
                                        (SEQ ID NO: 302)
DIQMTQSPSTLSASVGDRVTITCQASQSISSWLAWYQQKPGKAPKLLIYE

ASKLASGVPSRFSGSGSGTEFTLTISSLQPDDFATYYCQQAYSVANVDNA

FGGGTKVEIKR.
```

In another embodiment, the invention includes antibodies and antibody fragments having binding specificity to HGF that bind the same epitope as Ab8 which contain a constant light chain sequence comprising the sequence set forth below:

```
                                        (SEQ ID NO: 310)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to HGF that contain one, two, or three of the polypeptide sequences of SEQ ID NO: 284; SEQ ID NO: 286; and SEQ ID NO: 288 which correspond to the complementarity-determining regions (CDRs, or hypervariable regions) of the heavy chain sequence of SEQ ID NO: 281 or which contain the variable heavy chain sequence of SEQ ID NO: 282, and/or which further contain one, two, or three of the polypeptide sequences of SEQ ID NO: 304; SEQ ID NO: 306; and SEQ ID NO: 308 which correspond to the complementarity-determining regions (CDRs, or hypervariable regions) of the light chain sequence of SEQ ID NO: 301 or which contain the variable light chain sequence of SEQ ID NO: 302, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 283; SEQ ID NO: 285; SEQ ID NO: 287; and SEQ ID NO: 289 which correspond to the framework regions (FRs or constant regions) of the heavy chain sequence of SEQ ID NO: 281 or the variable heavy chain sequence of SEQ ID NO: 282, and/or one, two, three, or four of the polypeptide sequences of SEQ ID NO: 303; SEQ ID NO: 305; SEQ ID NO: 307; and SEQ ID NO: 309 which correspond to the framework regions (FRs or constant regions) of the light chain sequence of SEQ ID NO: 301 or the variable light chain sequence of SEQ ID NO: 302, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 281 or SEQ ID NO: 282 or polypeptides that are at least 90% or 95% identical thereto. In another embodiment of the invention, antibody fragments of the invention comprise, or alternatively consist of, the polypeptide sequence of SEQ ID NO: 301 or SEQ ID NO: 302 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 284; SEQ ID NO: 286; and SEQ ID NO: 288 which correspond to the complementarity-determining regions (CDRs, or hypervariable regions) of the heavy chain sequence of SEQ ID NO: 281 or the variable heavy chain sequence of SEQ ID NO: 282 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 304; SEQ ID NO: 306; and SEQ ID NO: 308 which correspond to the complementarity-determining regions (CDRs, or hypervariable regions) of the light chain sequence of SEQ ID NO: 301 or the variable light chain sequence of SEQ ID NO: 302 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 283; SEQ ID NO: 285; SEQ ID NO: 287; and SEQ ID NO: 289 which correspond to the framework regions (FRs or constant regions) of the heavy chain sequence of SEQ ID NO: 281 or the variable heavy chain sequence of SEQ ID NO: 282 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 303; SEQ ID NO: 305; SEQ ID NO: 307; and SEQ ID NO: 309 which correspond to the framework regions (FRs or constant regions) of the light chain sequence of SEQ ID NO: 301 or the variable light chain sequence of SEQ ID NO: 302 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 282; the variable light chain region of SEQ ID NO: 302; the complementarity-determining regions (SEQ ID NO: 284; SEQ ID NO: 286; and SEQ ID NO: 288) of the variable heavy chain region of SEQ ID NO: 282; and the complementarity-determining regions (SEQ ID NO: 304; SEQ ID NO: 306; and SEQ ID NO: 308) of the variable light chain region of SEQ ID NO: 302 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 282; the variable light chain region of SEQ ID NO: 302; the framework regions (SEQ ID NO: 283; SEQ ID NO: 285; SEQ ID NO: 287; and SEQ ID NO: 289) of the variable heavy chain region of SEQ ID NO: 282; and the framework regions (SEQ ID NO: 303; SEQ ID NO: 305; SEQ ID NO: 307; and SEQ ID NO: 309) of the variable light chain region of SEQ ID NO: 302.

In a particularly preferred embodiment of the invention, the anti-HGF antibody is Ab8, comprising, or alternatively consisting of, SEQ ID NO: 281 and SEQ ID NO: 301, or an antibody or antibody fragment comprising the CDRs of Ab8 and having at least one of the biological activities set forth herein or is an anti-HGF antibody that competes with Ab8 in binding HGF, preferably one containing sequences that are at least 90% or 95% identical to that of Ab8 or an antibody that binds to the same or overlapping epitope(s) on HGF as Ab8.

In a further particularly preferred embodiment of the invention, antibody fragments comprise, or alternatively consist of, Fab (fragment antigen binding) fragments having binding specificity for HGF. With respect to antibody Ab8, the Fab fragment preferably includes the variable heavy chain sequence of SEQ ID NO: 282 and the variable light chain sequence of SEQ ID NO: 302 or sequences that are at least 90% or 95% identical thereto. This embodiment of the invention further includes Fabs containing additions, deletions, and variants of SEQ ID NO: 282 and/or SEQ ID NO: 302 which retain the binding specificity for HGF.

In one embodiment of the invention described herein (infra), Fab fragments may be produced by enzymatic digestion (e.g., papain) of Ab8. In another embodiment of the invention, anti-HGF antibodies such as Ab8 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab8 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab9

In one embodiment, the invention includes antibodies and antibody fragments having binding specificity to HGF that possess a heavy chain sequence comprising the sequence set forth below:

(SEQ ID NO: 321)
QSVEESGGRLVTPGTPLTLTCTVSGIDLNSNGMSWVRQAPGEGLEWIGAS

SIDGTTYYTNWAKGRFTISKTSSTTVDLKITSPTTEDTATYFCTRGEYAG

VVGSNYFDLWGQGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLSPG

K.

In one embodiment, the invention includes antibodies and antibody fragments having binding specificity to HGF that contain a variable heavy chain sequence comprising the sequence set forth below:

(SEQ ID NO: 322)
QSVEESGGRLVTPGTPLTLTCTVSGIDLNSNGMSWVRQAPGEGLEWIGAS

SIDGTTYYTNWAKGRFTISKTSSTTVDLKITSPTTEDTATYFCTRGEYAG

VVGSNYFDLWGQGTLVTVSS.

In another embodiment, the invention includes antibodies and antibody fragments having binding specificity to HGF that possess the same epitopic specificity as Ab9 and which contain a constant heavy chain sequence comprising the sequence set forth below:

(SEQ ID NO: 330)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 341)
QVLTQTPPSVSAVVGGTVTINCQSSQRIYSNWLSWYQQKPGQTPKPLIYA

ASSLASGVPSRFKGSGSGTQFTLTISDLECDDAASYYCAGYYSGHIYSFG

GGTEVVVKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC.

In another embodiment, the invention includes antibodies and antibody fragments having binding specificity to HGF that contain a variable light chain sequence comprising the sequence set forth below:

(SEQ ID NO: 342)
QVLTQTPPSVSAVVGGTVTINCQSSQRIYSNWLSWYQQKPGQTPKPLIYA

ASSLASGVPSRFKGSGSGTQFTLTISDLECDDAASYYCAGYYSGHIYSFG

GGTEVVVKR.

In another embodiment, the invention includes antibodies and antibody fragments having binding specificity to HGF that bind the same epitope as Ab9 which contain a constant light chain sequence comprising the sequence set forth below:

(SEQ ID NO: 350)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 324; SEQ ID NO: 326; and SEQ ID NO: 328 which correspond to the complementarity-determining regions (CDRs, or hypervariable regions) of the heavy chain sequence of SEQ ID NO: 321 or which contain the variable heavy chain sequence of SEQ ID NO: 322, and/or which further contain one, two, or three of the polypeptide sequences of SEQ ID NO: 344; SEQ ID NO: 346; and SEQ ID NO: 348 which correspond to the complementarity-determining regions (CDRs, or hypervariable regions) of the light chain sequence of SEQ ID NO: 341 or which contain the variable light chain sequence of SEQ ID NO: 342, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 323; SEQ ID NO: 325; SEQ ID NO: 327; and SEQ ID NO: 329 which correspond to the framework regions (FRs or constant regions) of the heavy chain sequence of SEQ ID NO: 321 or the variable heavy chain sequence of SEQ ID NO: 322, and/or one, two, three, or four of the polypeptide sequences of SEQ ID NO: 343; SEQ ID NO: 345; SEQ ID NO: 347; and SEQ ID NO: 349 which correspond to the framework regions (FRs or constant regions) of the light chain sequence of SEQ ID NO: 341 or the variable light chain sequence of SEQ ID NO: 342, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 321 or SEQ ID NO: 322 or polypeptides that are at least 90% or 95% identical thereto. In another embodiment of the invention, antibody fragments of the invention comprise, or alternatively consist of, the polypeptide sequence of SEQ ID NO: 341 or SEQ ID NO: 342 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 324; SEQ ID NO: 326; and SEQ ID NO: 328 which correspond to the complementarity-determining regions (CDRs, or hypervariable regions) of the heavy chain sequence of SEQ ID NO: 321 or the variable heavy chain sequence of SEQ ID NO: 322 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 344; SEQ ID NO: 346; and SEQ ID NO: 348 which correspond to the complementarity-determining regions (CDRs, or hypervariable regions) of the light chain sequence of SEQ ID NO: 341 or the variable light chain sequence of SEQ ID NO: 342 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 323; SEQ ID NO: 325; SEQ ID NO: 327; and SEQ ID NO: 329 which correspond to the framework regions (FRs or constant regions) of the heavy chain sequence of SEQ ID NO: 321 or the variable heavy chain sequence of SEQ ID NO: 322 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 343; SEQ ID NO: 345; SEQ ID NO: 347; and SEQ ID NO: 349 which correspond to the framework regions (FRs or constant regions) of the light chain sequence of SEQ ID NO: 341 or the variable light chain sequence of SEQ ID NO: 342 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 322; the variable light chain region of SEQ ID NO: 342; the complementarity-determining regions (SEQ ID NO: 324; SEQ ID NO: 326; and SEQ ID NO: 328) of the variable heavy chain region of SEQ ID NO: 322; and the complementarity-determining regions (SEQ ID NO: 344; SEQ ID NO: 346; and SEQ ID NO: 348) of the variable light chain region of SEQ ID NO: 342 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 322; the variable light chain region of SEQ ID NO: 342; the framework regions (SEQ ID NO: 323; SEQ ID NO: 325; SEQ ID NO: 327; and SEQ ID NO: 329) of the variable heavy chain region of SEQ ID NO: 322; and the framework regions (SEQ ID NO: 343; SEQ ID NO: 345; SEQ ID NO: 347; and SEQ ID NO: 349) of the variable light chain region of SEQ ID NO: 342.

In a particularly preferred embodiment of the invention, the anti-HGF antibody is Ab9, comprising, or alternatively consisting of, SEQ ID NO: 321 and SEQ ID NO: 341, or an antibody or antibody fragment comprising the CDRs of Ab9 and having at least one of the biological activities set forth herein or is an anti-HGF antibody that competes with Ab9 in binding HGF, preferably one containing sequences that are at least 90% or 95% identical to that of Ab9 or an antibody that binds to the same or overlapping epitope(s) on HGF as Ab9.

In a further particularly preferred embodiment of the invention, antibody fragments comprise, or alternatively consist of, Fab (fragment antigen binding) fragments having binding specificity for HGF. With respect to antibody Ab9, the Fab fragment preferably includes the variable heavy chain sequence of SEQ ID NO: 322 and the variable light chain sequence of SEQ ID NO: 342 or sequences that are at least 90% or 95% identical thereto. This embodiment of the invention further includes Fabs containing additions, deletions, and variants of SEQ ID NO: 322 and/or SEQ ID NO: 342 which retain the binding specificity for HGF.

In one embodiment of the invention described herein (infra), Fab fragments may be produced by enzymatic digestion (e.g., papain) of Ab9. In another embodiment of the invention, anti-HGF antibodies such as Ab9 or Fab fragments thereof may be produced via expression in mammalian cells such as CHO, NS0 or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab9 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab10

In one embodiment, the invention includes antibodies and antibody fragments having binding specificity to HGF that possess a heavy chain sequence comprising the sequence set forth below:

(SEQ ID NO: 361)
EVQLVESGGGLVQPGGSLRLSCAASGFTVSSNGMSWVRQAPGKGLEWVGA

SSIDGTTYYTNSAKGRFTISRDNSKNTLYLQMNSLRAEDTAVYYCARGEY

AGVVGSNYFDLWGQGTLVTVSSASTKGPSVFPLAPSSKSTSGGTAALGCL

-continued

VKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREEQ

YASTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTP

PVLDSDGSFFLYSKLTVDKSRWQQGNVFSCSVMHEALHNHYTQKSLSLSP

GK.

In one embodiment, the invention includes antibodies and antibody fragments having binding specificity to HGF that contain a variable heavy chain sequence comprising the sequence set forth below:

(SEQ ID NO: 362)
EVQLVESGGGLVQPGGSLRLSCAASGFTVSSNGMSWVRQAPGKGLEWVGA

SSIDGTTYYTNSAKGRFTISRDNSKNTLYLQMNSLRAEDTAVYYCARGEY

AGVVGSNYFDLWGQGTLVTVSS.

In another embodiment, the invention includes antibodies and antibody fragments having binding specificity to HGF that possess the same epitopic specificity as Ab10 and which contain a constant heavy chain sequence comprising the sequence set forth below:

(SEQ ID NO: 370)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 381)
DIQMTQSPSSVSASVGDRVTITCQSSQRIYSNWLSWYQQKPGKAPKLLIY

AASSLASGVPSRFSGSGSGTDFTLTISSLQPEDFATYYCAGYYSGHIYSF

GGGTKVEIKRTVAAPSVFIFPPSDEQLKSGTASVVCLLNNFYPREAKVQW

KVDNALQSGNSQESVTEQDSKDSTYSLSSTLTLSKADYEKHKVYACEVTH

QGLSSPVTKSFNRGEC.

In another embodiment, the invention includes antibodies and antibody fragments having binding specificity to HGF that contain a variable light chain sequence comprising the sequence set forth below:

(SEQ ID NO: 382)
DIQMTQSPSSVSASVGDRVTITCQSSQRIYSNWLSWYQQKPGKAPKLLIY

AASSLASGVPSRFSGSGSGTDFTLTISSLQPEDFATYYCAGYYSGHIYSF

GGGTKVEIKR.

In another embodiment, the invention includes antibodies and antibody fragments having binding specificity to HGF that bind the same epitope as Ab10 which contain a constant light chain sequence comprising the sequence set forth below:

(SEQ ID NO: 390)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 364; SEQ ID NO: 366; and SEQ ID NO: 368 which correspond to the complementarity-determining regions (CDRs, or hypervariable regions) of the heavy chain sequence of SEQ ID NO: 361 or which contain the variable heavy chain sequence of SEQ ID NO: 362, and/or which further contain one, two, or three of the polypeptide sequences of SEQ ID NO: 384; SEQ ID NO: 386; and SEQ ID NO: 388 which correspond to the complementarity-determining regions (CDRs, or hypervariable regions) of the light chain sequence of SEQ ID NO: 381 or which contain the variable light chain sequence of SEQ ID NO: 382, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 363; SEQ ID NO: 365; SEQ ID NO: 367; and SEQ ID NO: 369 which correspond to the framework regions (FRs or constant regions) of the heavy chain sequence of SEQ ID NO: 361 or the variable heavy chain sequence of SEQ ID NO: 362, and/or one, two, three, or four of the polypeptide sequences of SEQ ID NO: 383; SEQ ID NO: 385; SEQ ID NO: 387; and SEQ ID NO: 389 which correspond to the framework regions (FRs or constant regions) of the light chain sequence of SEQ ID NO: 381 or the variable light chain sequence of SEQ ID NO: 382, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 361 or SEQ ID NO: 362 or polypeptides that are at least 90% or 95% identical thereto. In another embodiment of the invention, antibody fragments of the invention comprise, or alternatively consist of, the polypeptide sequence of SEQ ID NO: 381 or SEQ ID NO: 382 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 364; SEQ ID NO: 366; and SEQ ID NO: 368 which correspond to the complementarity-determining regions (CDRs, or hypervariable regions) of the heavy chain sequence of SEQ ID NO: 361 or the variable heavy chain sequence of SEQ ID NO: 362 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 384; SEQ ID NO: 386; and SEQ ID NO: 388 which correspond to the complementarity-determining regions (CDRs, or hypervariable regions) of the light chain sequence of SEQ ID NO: 381 or the variable light chain sequence of SEQ ID NO: 382 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 363; SEQ ID NO: 365; SEQ ID NO: 367; and SEQ ID NO: 369 which correspond to the framework regions (FRs or constant regions) of the heavy chain sequence of SEQ ID NO: 361 or the variable heavy chain sequence of SEQ ID NO: 362 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 383; SEQ ID NO: 385; SEQ ID NO: 387; and SEQ ID NO: 389 which correspond to the framework regions (FRs or constant regions) of the light chain sequence of SEQ ID NO: 381 or the variable light chain sequence of SEQ ID NO: 382 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 362; the variable light chain region of SEQ ID NO: 382; the complementarity-determining regions (SEQ ID NO: 364; SEQ ID NO: 366; and SEQ ID NO: 368) of the variable heavy chain region of SEQ ID NO: 362; and the complementarity-determining regions (SEQ ID NO: 384; SEQ ID NO: 386; and SEQ ID NO: 388) of the variable light chain region of SEQ ID NO: 382 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 362; the variable light chain region of SEQ ID NO: 382; the framework regions (SEQ ID NO: 363; SEQ ID NO: 365; SEQ ID NO: 367; and SEQ ID NO: 369) of the variable heavy chain region of SEQ ID NO: 362; and the framework regions (SEQ ID NO: 383; SEQ ID NO: 385; SEQ ID NO: 387; and SEQ ID NO: 389) of the variable light chain region of SEQ ID NO: 382.

In a particularly preferred embodiment of the invention, the anti-HGF antibody is Ab10, comprising, or alternatively consisting of, SEQ ID NO: 361 and SEQ ID NO: 381, or an antibody or antibody fragment comprising the CDRs of Ab10 and having at least one of the biological activities set forth herein or is an anti-HGF antibody that competes with Ab10 in binding HGF, preferably one containing sequences that are at least 90% or 95% identical to that of Ab10 or an antibody that binds to the same or overlapping epitope(s) on HGF as Ab10.

In a further particularly preferred embodiment of the invention, antibody fragments comprise, or alternatively consist of, Fab (fragment antigen binding) fragments having binding specificity for HGF. With respect to antibody Ab10, the Fab fragment preferably includes the variable heavy chain sequence of SEQ ID NO: 362 and the variable light chain sequence of SEQ ID NO: 382 or sequences that are at least 90% or 95% identical thereto. This embodiment of the invention further includes Fabs containing additions, deletions, and variants of SEQ ID NO: 362 and/or SEQ ID NO: 382 which retain the binding specificity for HGF.

In one embodiment of the invention described herein (infra), Fab fragments may be produced by enzymatic digestion (e.g., papain) of Ab10. In another embodiment of the invention, anti-HGF antibodies such as Ab10 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab10 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab11

In one embodiment, the invention includes antibodies and antibody fragments having binding specificity to HGF that possess a heavy chain sequence comprising the sequence set forth below:

```
                                         (SEQ ID NO: 401)
QSMEESGGRLVTPGTPLTLTCTVSGFSLSDYALSWVRQAPGKGLEWIGMI

SSGDNTYYASWAKGRFTISKASTTVDLKITSPTTEDTATYFCARDKDASS

GGYLVLDLLDVPDGMDLWGPGTLVTVSSASTKGPSVFPLAPSSKSTSGGT

AALGCLVKDYFPEPVTVSWNSGALTSGVHTFPAVLQSSGLYSLSSVVTVP

SSSLGTQTYICNVNHKPSNTKVDKRVEPKSCDKTHTCPPCPAPELLGGPS

VFLFPPKPKDTLMISRTPEVTCVVVDVSHEDPEVKFNWYVDGVEVHNAKT

KPREEQYASTYRVVSVLTVLHQDWLNGKEYKCKVSNKALPAPIEKTISKA

KGQPREPQVYTLPPSREEMTKNQVSLTCLVKGFYPSDIAVEWESNGQPEN

NYKTTPPVLDSDGSFFLYSKLTVDKSRWQQGNVFSCSVMHEALHNHYTQK

SLSLSPGK.
```

In one embodiment, the invention includes antibodies and antibody fragments having binding specificity to HGF that contain a variable heavy chain sequence comprising the sequence set forth below:

(SEQ ID NO: 402)
QSMEESGGRLVTPGTPLTLTCTVSGFSLSDYALSWVRQAPGKGLEWIGMI

SSGDNTYYASWAKGRFTISKASTTVDLKITSPTTEDTATYFCARDKDASS

GGYLVLDLLDVPDGMDLWGPGTLVTVSS.

In another embodiment, the invention includes antibodies and antibody fragments having binding specificity to HGF that possess the same epitopic specificity as Ab11 and which contain a constant heavy chain sequence comprising the sequence set forth below:

(SEQ ID NO: 410)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 421)
AVLTQTPSPVSAAVGGTVTIKCQSSQSVYNNNLLSWYQQKPGQPPKLLIW

GASYLPSGVPDRFSGSGSGTQFTLTISGVQCDDAATYYCLGGYDGDADTY

NTFGGGTEVVVKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.

In another embodiment, the invention includes antibodies and antibody fragments having binding specificity to HGF that contain a variable light chain sequence comprising the sequence set forth below:

(SEQ ID NO: 422)
AVLTQTPSPVSAAVGGTVTIKCQSSQSVYNNNLLSWYQQKPGQPPKLLIW

GASYLPSGVPDRFSGSGSGTQFTLTISGVQCDDAATYYCLGGYDGDADTY

NTFGGGTEVVVKR.

In another embodiment, the invention includes antibodies and antibody fragments having binding specificity to HGF that bind the same epitope as Ab11 which contain a constant light chain sequence comprising the sequence set forth below:

(SEQ ID NO: 430)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 404; SEQ ID NO: 406; and SEQ ID NO: 408 which correspond to the complementarity-determining regions (CDRs, or hypervariable regions) of the heavy chain sequence of SEQ ID NO: 401 or which contain the variable heavy chain sequence of SEQ ID NO: 402, and/or which further contain one, two, or three of the polypeptide sequences of SEQ ID NO: 424; SEQ ID NO: 426; and SEQ ID NO: 428 which correspond to the complementarity-determining regions (CDRs, or hypervariable regions) of the light chain sequence of SEQ ID NO: 421 or which contain the variable light chain sequence of SEQ ID NO: 422, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 403; SEQ ID NO: 405; SEQ ID NO: 407; and SEQ ID NO: 409 which correspond to the framework regions (FRs or constant regions) of the heavy chain sequence of SEQ ID NO: 401 or the variable heavy chain sequence of SEQ ID NO: 402, and/or one, two, three, or four of the polypeptide sequences of SEQ ID NO: 423; SEQ ID NO: 425; SEQ ID NO: 427; and SEQ ID NO: 429 which correspond to the framework regions (FRs or constant regions) of the light chain sequence of SEQ ID NO: 421 or the variable light chain sequence of SEQ ID NO: 422, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 401 or SEQ ID NO: 402 or polypeptides that are at least 90% or 95% identical thereto. In another embodiment of the invention, antibody fragments of the invention comprise, or alternatively consist of, the polypeptide sequence of SEQ ID NO: 421 or SEQ ID NO: 422 or polypeptides that are at least 90% or 95% identical thereto.

In a further embodiment of the invention, the antibody or antibody fragment having binding specificity to HGF comprises, or alternatively consists of, one, two or three of the polypeptide sequences of SEQ ID NO: 404; SEQ ID NO: 406; and SEQ ID NO: 408 which correspond to the complementarity-determining regions (CDRs, or hypervariable regions) of the heavy chain sequence of SEQ ID NO: 401 or the variable heavy chain sequence of SEQ ID NO: 402 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 424; SEQ ID NO: 426; and SEQ ID NO: 428 which correspond to the complementarity-determining regions (CDRs, or hypervariable regions) of the light chain sequence of SEQ ID NO: 421 or the variable light chain sequence of SEQ ID NO: 422 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 403; SEQ ID NO: 405; SEQ ID NO: 407; and SEQ ID NO: 409 which correspond to the framework regions (FRs or constant regions) of the heavy chain sequence of SEQ ID NO: 401 or the variable heavy chain sequence of SEQ ID NO: 402 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 423; SEQ ID NO: 425; SEQ ID NO: 427; and SEQ ID NO: 429 which correspond to the framework regions (FRs or constant regions) of the light chain sequence of SEQ ID NO: 421 or the variable light chain sequence of SEQ ID NO: 422 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 402; the variable light chain region of SEQ ID NO: 422; the complementarity-determining regions (SEQ ID NO: 404; SEQ ID NO: 406; and SEQ ID NO: 408) of the variable heavy chain region of SEQ ID NO: 402; and the complementarity-determining regions (SEQ ID NO: 424; SEQ ID NO: 426; and SEQ ID NO: 428) of the variable light chain region of SEQ ID NO: 422 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 402; the variable light chain region of SEQ ID NO: 422; the framework regions (SEQ ID NO: 403; SEQ ID NO: 405; SEQ ID NO: 407; and SEQ ID NO: 409) of the variable heavy chain region of SEQ ID NO: 402; and the framework regions (SEQ ID NO: 423; SEQ ID NO: 425; SEQ ID NO: 427; and SEQ ID NO: 429) of the variable light chain region of SEQ ID NO: 422.

In a particularly preferred embodiment of the invention, the anti-HGF antibody is Ab11, comprising, or alternatively consisting of, SEQ ID NO: 401 and SEQ ID NO: 421, or an antibody or antibody fragment comprising the CDRs of Ab11 and having at least one of the biological activities set forth herein or is an anti-HGF antibody that competes with Ab11 in binding HGF, preferably one containing sequences that are at least 90% or 95% identical to that of Ab11 or an antibody that binds to the same or overlapping epitope(s) on HGF as Ab11.

In a further particularly preferred embodiment of the invention, antibody fragments comprise, or alternatively consist of, Fab (fragment antigen binding) fragments having binding specificity for HGF. With respect to antibody Ab11, the Fab fragment preferably includes the variable heavy chain sequence of SEQ ID NO: 402 and the variable light chain sequence of SEQ ID NO: 422 or sequences that are at least 90% or 95% identical thereto. This embodiment of the invention further includes Fabs containing additions, deletions, and variants of SEQ ID NO: 402 and/or SEQ ID NO: 422 which retain the binding specificity for HGF.

In one embodiment of the invention described herein (infra), Fab fragments may be produced by enzymatic digestion (e.g., papain) of Ab11. In another embodiment of the invention, anti-HGF antibodies such as Ab11 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab11 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab12

In one embodiment, the invention includes antibodies and antibody fragments having binding specificity to HGF that possess a heavy chain sequence comprising the sequence set forth below:

(SEQ ID NO: 441)
QSLEESGGRLVTPGGSLTLTCTVSGIDLSSNAISWVRQAPEKGLEWIAVI

YVVGATDYASWAKGRFTISRTSTTVDLKMTSLTTEDTATYFCARVYDSGW

NHFNLWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 442)
QSLEESGGRLVTPGGSLTLTCTVSGIDLSSNAISWVRQAPEKGLEWIAVI

YVVGATDYASWAKGRFTISRTSTTVDLKMTSLTTEDTATYFCARVYDSGW

NHFNLWGPGTLVTVSS.

In another embodiment, the invention includes antibodies and antibody fragments having binding specificity to HGF that possess the same epitopic specificity as Ab12 and which contain a constant heavy chain sequence comprising the sequence set forth below:

(SEQ ID NO: 450)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 461)
AYDMTQTPASVEVAVGGTVTIKCQVSQSISSWLSWYQKKPGQRPKLLIYR

ASTLASGVSSRFKGSGSGTEFTLTISGVECADAATYYCQQAYSVSNVDNA

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 462)
AYDMTQTPASVEVAVGGTVTIKCQVSQSISSWLSWYQKKPGQRPKLLIYR

ASTLASGVSSRFKGSGSGTEFTLTISGVECADAATYYCQQAYSVSNVDNA

FGGGTEVVVKR.

In another embodiment, the invention includes antibodies and antibody fragments having binding specificity to HGF that bind the same epitope as Ab12 which contain a constant light chain sequence comprising the sequence set forth below:

(SEQ ID NO: 470)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 444; SEQ ID NO: 446; and SEQ ID NO: 448 which correspond to the complementarity-determining regions (CDRs, or hypervariable regions) of the heavy chain sequence of SEQ ID NO: 441 or which contain the variable heavy chain sequence of SEQ ID NO: 442, and/or which further contain one, two, or three of the polypeptide sequences of SEQ ID NO: 464; SEQ ID NO: 466; and SEQ ID NO: 468 which correspond to the complementarity-determining regions (CDRs, or hypervariable regions) of the light chain sequence of SEQ ID NO: 461 or which contain the variable light chain sequence of SEQ ID NO: 462, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 443; SEQ ID NO: 445; SEQ ID NO: 447; and SEQ ID NO: 449 which correspond to the framework regions (FRs or constant regions) of the heavy chain sequence of SEQ ID NO: 441 or the variable heavy chain sequence of SEQ ID NO: 442, and/or one, two, three, or four of the polypeptide sequences of SEQ ID NO: 463; SEQ ID NO: 465; SEQ ID NO: 467; and SEQ ID NO: 469 which correspond to the framework regions (FRs or constant regions) of the light chain sequence of SEQ ID NO: 461 or the variable light chain sequence of SEQ ID NO: 462, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 441 or SEQ ID NO: 442 or polypeptides that are at least 90% or 95% identical thereto. In another embodiment of the invention, antibody fragments of the invention comprise, or alternatively consist of, the polypeptide sequence of SEQ ID NO: 461 or SEQ ID NO: 462 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 444; SEQ ID NO: 446; and SEQ ID NO: 448 which correspond to the complementarity-determining regions (CDRs, or hypervariable regions) of the heavy chain sequence of SEQ ID NO: 441 or the variable heavy chain sequence of SEQ ID NO: 442 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 464; SEQ ID NO: 466; and SEQ ID NO: 468 which correspond to the complementarity-determining regions (CDRs, or hypervariable regions) of the light chain sequence of SEQ ID NO: 461 or the variable light chain sequence of SEQ ID NO: 462 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 443; SEQ ID NO: 445; SEQ ID NO: 447; and SEQ ID NO: 449 which correspond to the framework regions (FRs or constant regions) of the heavy chain sequence of SEQ ID NO: 441 or the variable heavy chain sequence of SEQ ID NO: 442 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 463; SEQ ID NO: 465; SEQ ID NO: 467; and SEQ ID NO: 469 which correspond to the framework regions (FRs or constant regions) of the light chain sequence of SEQ ID NO: 461 or the variable light chain sequence of SEQ ID NO: 462 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 442; the variable light chain region of SEQ ID NO: 462; the complementarity-determining regions (SEQ ID NO: 444; SEQ ID NO: 446; and SEQ ID NO: 448) of the variable heavy chain region of SEQ ID NO: 442; and the complementarity-determining regions (SEQ ID NO: 464; SEQ ID NO: 466; and SEQ ID NO: 468) of the variable light chain region of SEQ ID NO: 462 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 442; the variable light chain region of SEQ ID NO: 462; the framework regions (SEQ ID NO: 443; SEQ ID NO: 445; SEQ ID NO: 447; and SEQ ID NO: 449) of the variable heavy chain region of SEQ ID NO: 442; and the framework regions (SEQ ID NO: 463; SEQ ID NO: 465; SEQ ID NO: 467; and SEQ ID NO: 469) of the variable light chain region of SEQ ID NO: 462.

In a particularly preferred embodiment of the invention, the anti-HGF antibody is Ab12, comprising, or alternatively consisting of, SEQ ID NO: 441 and SEQ ID NO: 461, or an antibody or antibody fragment comprising the CDRs of Ab12 and having at least one of the biological activities set forth herein or is an anti-HGF antibody that competes with Ab12 in binding HGF, preferably one containing sequences that are at least 90% or 95% identical to that of Ab12 or an antibody that binds to the same or overlapping epitope(s) on HGF as Ab12.

In a further particularly preferred embodiment of the invention, antibody fragments comprise, or alternatively consist of, Fab (fragment antigen binding) fragments having binding specificity for HGF. With respect to antibody Ab12, the Fab fragment preferably includes the variable heavy chain sequence of SEQ ID NO: 442 and the variable light chain sequence of SEQ ID NO: 462 or sequences that are at least 90% or 95% identical thereto. This embodiment of the invention further includes Fabs containing additions, deletions, and variants of SEQ ID NO: 442 and/or SEQ ID NO: 462 which retain the binding specificity for HGF.

In one embodiment of the invention described herein (infra), Fab fragments may be produced by enzymatic digestion (e.g., papain) of Ab12. In another embodiment of the invention, anti-HGF antibodies such as Ab12 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab12 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab13

In one embodiment, the invention includes antibodies and antibody fragments having binding specificity to HGF that possess a heavy chain sequence comprising the sequence set forth below:

(SEQ ID NO: 481)
EVQLVESGGGLVQPGGSLRLSCAASGFTVSSNAISWVRQAPGKGLEWVAV

AIYVVGTDYASSAKGRFTISRDNSKNTLYLQMNSLRAEDTAVYYCARVYD

SGWNHFNLWGQGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 482)
EVQLVESGGGLVQPGGSLRLSCAASGFTVSSNAISWVRQAPGKGLEWVAV

IYVVGATDYASSAKGRFTISRDNSKNTLYLQMNSLRAEDTAVYYCARVYD

SGWNHFNLWGQGTLVTVSS.

In another embodiment, the invention includes antibodies and antibody fragments having binding specificity to HGF that possess the same epitopic specificity as Ab13 and which contain a constant heavy chain sequence comprising the sequence set forth below:

(SEQ ID NO: 490)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 501)
DYQMTQSPSTLSASVGDRVTITCQVSQSISSWLSWYQQKPGKAPKLLIYR

ASTLASGVPSRFSGSGSGTEFTLTISSLQPDDFATYYCQQAYSVSNVDNA

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 502)
DYQMTQSPSTLSASVGDRVTITCQVSQSISSWLSWYQQKPGKAPKLLIYR

ASTLASGVPSRFSGSGSGTEFTLTISSLQPDDFATYYCQQAYSVSNVDNA

FGGGTKVEIKR.

In another embodiment, the invention includes antibodies and antibody fragments having binding specificity to HGF that bind the same epitope as Ab13 which contain a constant light chain sequence comprising the sequence set forth below:

(SEQ ID NO: 510)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 484; SEQ ID NO: 486; and SEQ ID NO: 488 which correspond to the complementarity-determining regions (CDRs, or hypervariable regions) of the heavy chain sequence of SEQ ID NO: 481 or which contain the variable heavy chain sequence of SEQ ID NO: 482, and/or which further contain one, two, or three of the polypeptide sequences of SEQ ID NO: 504; SEQ ID NO: 506; and SEQ ID NO: 508 which correspond to the complementarity-determining regions (CDRs, or hypervariable regions) of the light chain sequence of SEQ ID NO: 501 or which contain the variable light chain sequence of SEQ ID NO: 502, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 483; SEQ ID NO: 485; SEQ ID NO: 487; and SEQ ID NO: 489 which correspond to the framework regions (FRs or constant regions) of the heavy chain sequence of SEQ ID NO: 481 or the variable heavy chain sequence of SEQ ID NO: 482, and/or one, two, three, or four of the polypeptide sequences of SEQ ID NO: 503; SEQ ID NO: 505; SEQ ID NO: 507; and SEQ ID NO: 509 which correspond to the framework regions (FRs or constant regions) of the light chain sequence of SEQ ID NO: 501 or the variable light chain sequence of SEQ ID NO: 502, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 481 or SEQ ID NO: 482 or polypeptides that are at least 90% or 95% identical thereto. In another embodiment of the invention, antibody fragments of the invention comprise, or alternatively consist of, the polypeptide sequence of SEQ ID NO: 501 or SEQ ID NO: 502 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 484; SEQ ID NO: 486; and SEQ ID NO: 488 which correspond to the complementarity-determining regions (CDRs, or hypervariable regions) of the heavy chain sequence of SEQ ID NO: 481 or the variable heavy chain sequence of SEQ ID NO: 482 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 504; SEQ ID NO: 506; and SEQ ID NO: 508 which correspond to the complementarity-determining regions (CDRs, or hypervariable regions) of the light chain sequence of SEQ ID NO: 501 or the variable light chain sequence of SEQ ID NO: 502 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 483; SEQ ID NO: 485; SEQ ID NO: 487; and SEQ ID NO: 489 which correspond to the framework regions (FRs or constant regions) of the heavy chain sequence of SEQ ID NO: 481 or the variable heavy chain sequence of SEQ ID NO: 482 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 503; SEQ ID NO: 505; SEQ ID NO: 507; and SEQ ID NO: 509 which correspond to the framework regions (FRs or constant regions) of the light chain sequence of SEQ ID NO: 501 or the variable light chain sequence of SEQ ID NO: 502 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 482; the variable light chain region of SEQ ID NO: 502; the complementarity-determining regions (SEQ ID NO: 484; SEQ ID NO: 486; and SEQ ID NO: 488) of the variable heavy chain region of SEQ ID NO: 482; and the complementarity-determining regions (SEQ ID NO: 504; SEQ ID NO: 506; and SEQ ID NO: 508) of the variable light chain region of SEQ ID NO: 502 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 482; the variable light chain region of SEQ ID NO: 502; the framework regions (SEQ ID NO: 483; SEQ ID NO: 485; SEQ ID NO: 487; and SEQ ID NO: 489) of the variable heavy chain region of SEQ ID NO: 482; and the framework regions (SEQ ID NO: 503; SEQ ID NO: 505; SEQ ID NO: 507; and SEQ ID NO: 509) of the variable light chain region of SEQ ID NO: 502.

In a particularly preferred embodiment of the invention, the anti-HGF antibody is Ab13, comprising, or alternatively consisting of, SEQ ID NO: 481 and SEQ ID NO: 501, or an antibody or antibody fragment comprising the CDRs of Ab13 and having at least one of the biological activities set forth herein or is an anti-HGF antibody that competes with Ab13 in binding HGF, preferably one containing sequences that are at least 90% or 95% identical to that of Ab13 or an antibody that binds to the same or overlapping epitope(s) on HGF as Ab13.

In a further particularly preferred embodiment of the invention, antibody fragments comprise, or alternatively consist of, Fab (fragment antigen binding) fragments having binding specificity for HGF. With respect to antibody Ab13, the Fab fragment preferably includes the variable heavy chain sequence of SEQ ID NO: 482 and the variable light chain sequence of SEQ ID NO: 502 or sequences that are at least 90% or 95% identical thereto. This embodiment of the invention further includes Fabs containing additions, deletions, and variants of SEQ ID NO: 482 and/or SEQ ID NO: 502 which retain the binding specificity for HGF.

In one embodiment of the invention described herein (infra), Fab fragments may be produced by enzymatic digestion (e.g., papain) of Ab13. In another embodiment of the invention, anti-HGF antibodies such as Ab13 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab13 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab14

In one embodiment, the invention includes antibodies and antibody fragments having binding specificity to HGF that possess a heavy chain sequence comprising the sequence set forth below:

```
                                             (SEQ ID NO: 521)
QSVEESGGRLVTPGTPLTLTCTVSGFSLSNYAMTWVRQAPGKGLEWIGVI

SFGGNTYYANWAKGRFTISKTSTTVDLKITSPTTEDTATYFCARWDAENN

EILNLWGQGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                             (SEQ ID NO: 522)
QSVEESGGRLVTPGTPLTLTCTVSGFSLSNYAMTWVRQAPGKGLEWIGVI

SFGGNTYYANWAKGRFTISKTSTTVDLKITSPTTEDTATYFCARWDAENN

EILNLWGQGTLVTVSS.
```

In another embodiment, the invention includes antibodies and antibody fragments having binding specificity to HGF that possess the same epitopic specificity as Ab14 and which contain a constant heavy chain sequence comprising the sequence set forth below:

```
                                             (SEQ ID NO: 530)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                             (SEQ ID NO: 541)
AYDMTQTPASVEVAVGGTVTIKCQASESIESYLAWYQQKSGQPPKLLIYR

ASTLASGVSSRFKGSGSGTQFTLTISGVECADAATYYCQQGDAWSNVDNV

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to HGF that contain a variable light chain sequence comprising the sequence set forth below:

(SEQ ID NO: 542)
AYDMTQTPASVEVAVGGTVTIKCQASESIESYLAWYQQKSGQPPKLLIYR

ASTLASGVSSRFKGSGSGTQFTLTISGVECADAATYYCQQGDAWSNVDNV

FGGGTEVVVKR.

In another embodiment, the invention includes antibodies and antibody fragments having binding specificity to HGF that bind the same epitope as Ab14 which contain a constant light chain sequence comprising the sequence set forth below:

(SEQ ID NO: 550)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 524; SEQ ID NO: 526; and SEQ ID NO: 528 which correspond to the complementarity-determining regions (CDRs, or hypervariable regions) of the heavy chain sequence of SEQ ID NO: 521 or which contain the variable heavy chain sequence of SEQ ID NO: 522, and/or which further contain one, two, or three of the polypeptide sequences of SEQ ID NO: 544; SEQ ID NO: 546; and SEQ ID NO: 548 which correspond to the complementarity-determining regions (CDRs, or hypervariable regions) of the light chain sequence of SEQ ID NO: 541 or which contain the variable light chain sequence of SEQ ID NO: 542, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 523; SEQ ID NO: 525; SEQ ID NO: 527; and SEQ ID NO: 529 which correspond to the framework regions (FRs or constant regions) of the heavy chain sequence of SEQ ID NO: 521 or the variable heavy chain sequence of SEQ ID NO: 522, and/or one, two, three, or four of the polypeptide sequences of SEQ ID NO: 543; SEQ ID NO: 545; SEQ ID NO: 547; and SEQ ID NO: 549 which correspond to the framework regions (FRs or constant regions) of the light chain sequence of SEQ ID NO: 541 or the variable light chain sequence of SEQ ID NO: 542, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 521 or SEQ ID NO: 522 or polypeptides that are at least 90% or 95% identical thereto. In another embodiment of the invention, antibody fragments of the invention comprise, or alternatively consist of, the polypeptide sequence of SEQ ID NO: 541 or SEQ ID NO: 542 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 524; SEQ ID NO: 526; and SEQ ID NO: 528 which correspond to the complementarity-determining regions (CDRs, or hypervariable regions) of the heavy chain sequence of SEQ ID NO: 521 or the variable heavy chain sequence of SEQ ID NO: 522 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 544; SEQ ID NO: 546; and SEQ ID NO: 548 which correspond to the complementarity-determining regions (CDRs, or hypervariable regions) of the light chain sequence of SEQ ID NO: 541 or the variable light chain sequence of SEQ ID NO: 542 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 523; SEQ ID NO: 525; SEQ ID NO: 527; and SEQ ID NO: 529 which correspond to the framework regions (FRs or constant regions) of the heavy chain sequence of SEQ ID NO: 521 or the variable heavy chain sequence of SEQ ID NO: 522 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 543; SEQ ID NO: 545; SEQ ID NO: 547; and SEQ ID NO: 549 which correspond to the framework regions (FRs or constant regions) of the light chain sequence of SEQ ID NO: 541 or the variable light chain sequence of SEQ ID NO: 542 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 522; the variable light chain region of SEQ ID NO: 542; the complementarity-determining regions (SEQ ID NO: 524; SEQ ID NO: 526; and SEQ ID NO: 528) of the variable heavy chain region of SEQ ID NO: 522; and the complementarity-determining regions (SEQ ID NO: 544; SEQ ID NO: 546; and SEQ ID NO: 548) of the variable light chain region of SEQ ID NO: 542 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 522; the variable light chain region of SEQ ID NO: 542; the framework regions (SEQ ID NO: 523; SEQ ID NO: 525; SEQ ID NO: 527; and SEQ ID NO: 529) of the variable heavy chain region of SEQ ID NO: 522; and the framework regions (SEQ ID NO: 543; SEQ ID NO: 545; SEQ ID NO: 547; and SEQ ID NO: 549) of the variable light chain region of SEQ ID NO: 542.

In a particularly preferred embodiment of the invention, the anti-HGF antibody is Ab14, comprising, or alternatively consisting of, SEQ ID NO: 521 and SEQ ID NO: 541, or an antibody or antibody fragment comprising the CDRs of Ab14 and having at least one of the biological activities set forth herein or is an anti-HGF antibody that competes with Ab14 in binding HGF, preferably one containing sequences that are at least 90% or 95% identical to that of Ab14 or an antibody that binds to the same or overlapping epitope(s) on HGF as Ab14.

In a further particularly preferred embodiment of the invention, antibody fragments comprise, or alternatively consist of, Fab (fragment antigen binding) fragments having binding specificity for HGF. With respect to antibody Ab14, the Fab fragment preferably includes the variable heavy chain sequence of SEQ ID NO: 522 and the variable light chain sequence of SEQ ID NO: 542 or sequences that are at least 90% or 95% identical thereto. This embodiment of the invention further includes Fabs containing additions, deletions, and variants of SEQ ID NO: 522 and/or SEQ ID NO: 542 which retain the binding specificity for HGF.

In one embodiment of the invention described herein (infra), Fab fragments may be produced by enzymatic digestion (e.g., papain) of Ab14. In another embodiment of the invention, anti-HGF antibodies such as Ab14 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab14 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab15

In one embodiment, the invention includes antibodies and antibody fragments having binding specificity to HGF that possess a heavy chain sequence comprising the sequence set forth below:

```
                                        (SEQ ID NO: 561)
QSVEESGGRLVTPGTPLTLTCTVSGFSLSNYAMTWVRQAPGKGLEWIGVI

SFGGNTYYANWAKGRFTISKTSTTVDLKITSPTTEDTATYFCARWDAENN

EILNLWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                        (SEQ ID NO: 562)
QSVEESGGRLVTPGTPLTLTCTVSGFSLSNYAMTWVRQAPGKGLEWIGVI

SFGGNTYYANWAKGRFTISKTSTTVDLKITSPTTEDTATYFCARWDAENN

EILNLWGPGTLVTVSS.
```

In another embodiment, the invention includes antibodies and antibody fragments having binding specificity to HGF that possess the same epitopic specificity as Ab15 and which contain a constant heavy chain sequence comprising the sequence set forth below:

```
                                        (SEQ ID NO: 570)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                        (SEQ ID NO: 581)
AYDMTQTPASVEVAVGGTVTIKCQASESISSYLAWYQQKSGQPPKLLIYR

ASTLASGVSSRFKGSGSGTQFTLTISGVECADAATYYCQQGDAWSNVDNV

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.
```

In another embodiment, the invention includes antibodies and antibody fragments having binding specificity to HGF that contain a variable light chain sequence comprising the sequence set forth below:

```
                                        (SEQ ID NO: 582)
AYDMTQTPASVEVAVGGTVTIKCQASESISSYLAWYQQKSGQPPKLLIYR

ASTLASGVSSRFKGSGSGTQFTLTISGVECADAATYYCQQGDAWSNVDNV

FGGGTEVVVKR.
```

In another embodiment, the invention includes antibodies and antibody fragments having binding specificity to HGF that bind the same epitope as Ab15 which contain a constant light chain sequence comprising the sequence set forth below:

(SEQ ID NO: 590)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 564; SEQ ID NO: 566; and SEQ ID NO: 568 which correspond to the complementarity-determining regions (CDRs, or hypervariable regions) of the heavy chain sequence of SEQ ID NO: 561 or which contain the variable heavy chain sequence of SEQ ID NO: 562, and/or which further contain one, two, or three of the polypeptide sequences of SEQ ID NO: 584; SEQ ID NO: 586; and SEQ ID NO: 588 which correspond to the complementarity-determining regions (CDRs, or hypervariable regions) of the light chain sequence of SEQ ID NO: 581 or which contain the variable light chain sequence of SEQ ID NO: 582, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 563; SEQ ID NO: 565; SEQ ID NO: 567; and SEQ ID NO: 569 which correspond to the framework regions (FRs or constant regions) of the heavy chain sequence of SEQ ID NO: 561 or the variable heavy chain sequence of SEQ ID NO: 562, and/or one, two, three, or four of the polypeptide sequences of SEQ ID NO: 583; SEQ ID NO: 585; SEQ ID NO: 587; and SEQ ID NO: 589 which correspond to the framework regions (FRs or constant regions) of the light chain sequence of SEQ ID NO: 581 or the variable light chain sequence of SEQ ID NO: 582, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 561 or SEQ ID NO: 562 or polypeptides that are at least 90% or 95% identical thereto. In another embodiment of the invention, antibody fragments of the invention comprise, or alternatively consist of, the polypeptide sequence of SEQ ID NO: 581 or SEQ ID NO: 582 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 564; SEQ ID NO: 566; and SEQ ID NO: 568 which correspond to the complementarity-determining regions (CDRs, or hypervariable regions) of the heavy chain sequence of SEQ ID NO: 561 or the variable heavy chain sequence of SEQ ID NO: 562 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 584; SEQ ID NO: 586; and SEQ ID NO: 588 which correspond to the complementarity-determining regions (CDRs, or hypervariable regions) of the light chain sequence of SEQ ID NO: 581 or the variable light chain sequence of SEQ ID NO: 582 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 563; SEQ ID NO: 565; SEQ ID NO: 567; and SEQ ID NO: 569 which correspond to the framework regions (FRs or constant regions) of the heavy chain sequence of SEQ ID NO: 561 or the variable heavy chain sequence of SEQ ID NO: 562 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 583; SEQ ID NO: 585; SEQ ID NO: 587; and SEQ ID NO: 589 which correspond to the framework regions (FRs or constant regions) of the light chain sequence of SEQ ID NO: 581 or the variable light chain sequence of SEQ ID NO: 582 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 562; the variable light chain region of SEQ ID NO: 582; the complementarity-determining regions (SEQ ID NO: 564; SEQ ID NO: 566; and SEQ ID NO: 568) of the variable heavy chain region of SEQ ID NO: 562; and the complementarity-determining regions (SEQ ID NO: 584; SEQ ID NO: 586; and SEQ ID NO: 588) of the variable light chain region of SEQ ID NO: 582 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 562; the variable light chain region of SEQ ID NO: 582; the framework regions (SEQ ID NO: 563; SEQ ID NO: 565; SEQ ID NO: 567; and SEQ ID NO: 569) of the variable heavy chain region of SEQ ID NO: 562; and the framework regions (SEQ ID NO: 583; SEQ ID NO: 585; SEQ ID NO: 587; and SEQ ID NO: 589) of the variable light chain region of SEQ ID NO: 582.

In a particularly preferred embodiment of the invention, the anti-HGF antibody is Ab15, comprising, or alternatively consisting of, SEQ ID NO: 561 and SEQ ID NO: 581, or an antibody or antibody fragment comprising the CDRs of Ab15 and having at least one of the biological activities set forth herein or is an anti-HGF antibody that competes with Ab15 in binding HGF, preferably one containing sequences that are at least 90% or 95% identical to that of Ab15 or an antibody that binds to the same or overlapping epitope(s) on HGF as Ab15.

In a further particularly preferred embodiment of the invention, antibody fragments comprise, or alternatively consist of, Fab (fragment antigen binding) fragments having binding specificity for HGF. With respect to antibody Ab15, the Fab fragment preferably includes the variable heavy chain sequence of SEQ ID NO: 562 and the variable light chain sequence of SEQ ID NO: 582 or sequences that are at least 90% or 95% identical thereto. This embodiment of the invention further includes Fabs containing additions, deletions, and variants of SEQ ID NO: 562 and/or SEQ ID NO: 582 which retain the binding specificity for HGF.

In one embodiment of the invention described herein (infra), Fab fragments may be produced by enzymatic digestion (e.g., papain) of Ab15. In another embodiment of the invention, anti-HGF antibodies such as Ab15 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab15 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab16

In one embodiment, the invention includes antibodies and antibody fragments having binding specificity to HGF that possess a heavy chain sequence comprising the sequence set forth below:

```
                                         (SEQ ID NO: 601)
QSVEESGGRLVTPGTPLTLTCTVSGIDLSNYAMGWVRQAPGKGLEYIGMI

GVNGRAWYATWAKGRFTISKTSPTVDLKITSPTTEDTATYFCARLIDERS

TYSYVFDLWGQGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                         (SEQ ID NO: 602)
QSVEESGGRLVTPGTPLTLTCTVSGIDLSNYAMGWVRQAPGKGLEYIGMI

GVNGRAWYATWAKGRFTISKTSPTVDLKITSPTTEDTATYFCARLIDERS

TYSYVFDLWGQGTLVTVSS.
```

In another embodiment, the invention includes antibodies and antibody fragments having binding specificity to HGF that possess the same epitopic specificity as Ab16 and which contain a constant heavy chain sequence comprising the sequence set forth below:

```
                                         (SEQ ID NO: 610)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                         (SEQ ID NO: 621)
QVLTQTPSPVSAAVGGTVTINCQGSQSLYNNNAFSWYQQKPGQPPKLLIY

DASTLASGVPSRFKGSGSGTQFTLTISGVQCADAATYYCQGEFSCGDVDC

IAFGGGTEVVVKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.
```

In another embodiment, the invention includes antibodies and antibody fragments having binding specificity to HGF that contain a variable light chain sequence comprising the sequence set forth below:

```
                                         (SEQ ID NO: 622)
QVLTQTPSPVSAAVGGTVTINCQGSQSLYNNNAFSWYQQKPGQPPKLLIY

DASTLASGVPSRFKGSGSGTQFTLTISGVQCADAATYYCQGEFSCGDVDC

IAFGGGTEVVVKR.
```

In another embodiment, the invention includes antibodies and antibody fragments having binding specificity to HGF that bind the same epitope as Ab16 which contain a constant light chain sequence comprising the sequence set forth below:

```
                                         (SEQ ID NO: 630)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to HGF that contain one, two, or three of the polypeptide sequences of SEQ ID NO: 604; SEQ ID NO: 606; and SEQ ID NO: 608 which correspond to the complementarity-determining regions (CDRs, or hypervariable regions) of the heavy chain sequence of SEQ ID NO: 601 or which contain the variable heavy chain sequence of SEQ ID NO: 602, and/or which further contain one, two, or three of the polypeptide sequences of SEQ ID NO: 624; SEQ ID NO: 626; and SEQ ID NO: 628 which correspond to the complementarity-determining regions (CDRs, or hypervariable regions) of the light chain sequence of SEQ ID NO: 621 or which contain the variable light chain sequence of SEQ ID NO: 622, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 603; SEQ ID NO: 605; SEQ ID NO: 607; and SEQ ID NO: 609 which correspond to the framework regions (FRs or constant regions) of the heavy chain sequence of SEQ ID NO: 601 or the variable heavy chain sequence of SEQ ID NO: 602, and/or one, two, three, or four of the polypeptide sequences of SEQ ID NO: 623; SEQ ID NO: 625; SEQ ID NO: 627; and SEQ ID NO: 629 which correspond to the framework regions (FRs or constant regions) of the light chain sequence of SEQ ID NO: 621 or the variable light chain sequence of SEQ ID NO: 622, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 601 or SEQ ID NO: 602 or polypeptides that are at least 90% or 95% identical thereto. In another embodiment of the invention, antibody fragments of the invention comprise, or alternatively consist of, the polypeptide sequence of SEQ ID NO: 621 or SEQ ID NO: 622 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 604; SEQ ID NO: 606; and SEQ ID NO: 608 which correspond to the complementarity-determining regions (CDRs, or hypervariable regions) of the heavy chain sequence of SEQ ID NO: 601 or the variable heavy chain sequence of SEQ ID NO: 602 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 624; SEQ ID NO: 626; and SEQ ID NO: 628 which correspond to the complementarity-determining regions (CDRs, or hypervariable regions) of the light chain sequence of SEQ ID NO: 621 or the variable light chain sequence of SEQ ID NO: 622 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 603; SEQ ID NO: 605; SEQ ID NO: 607; and SEQ ID NO: 609 which correspond to the framework regions (FRs or constant regions) of the heavy chain sequence of SEQ ID NO: 601 or the variable heavy chain sequence of SEQ ID NO: 602 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 623; SEQ ID NO: 625; SEQ ID NO: 627; and SEQ ID NO: 629 which correspond to the framework regions (FRs or constant regions) of the light chain sequence of SEQ ID NO: 621 or the variable light chain sequence of SEQ ID NO: 622 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 602; the variable light chain region of SEQ ID NO: 622; the complementarity-determining regions (SEQ ID NO: 604; SEQ ID NO: 606; and SEQ ID NO: 608) of the variable heavy chain region of SEQ ID NO: 602; and the complementarity-determining regions (SEQ ID NO: 624; SEQ ID NO: 626; and SEQ ID NO: 628) of the variable light chain region of SEQ ID NO: 622 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 602; the variable light chain region of SEQ ID NO: 622; the framework regions (SEQ ID NO: 603; SEQ ID NO: 605; SEQ ID NO: 607; and SEQ ID NO: 609) of the variable heavy chain region of SEQ ID NO: 602; and the framework regions (SEQ ID NO: 623; SEQ ID NO: 625; SEQ ID NO: 627; and SEQ ID NO: 629) of the variable light chain region of SEQ ID NO: 622.

In a particularly preferred embodiment of the invention, the anti-HGF antibody is Ab16, comprising, or alternatively consisting of, SEQ ID NO: 601 and SEQ ID NO: 621, or an antibody or antibody fragment comprising the CDRs of Ab16 and having at least one of the biological activities set forth herein or is an anti-HGF antibody that competes with Ab16 in binding HGF, preferably one containing sequences that are at least 90% or 95% identical to that of Ab16 or an antibody that binds to the same or overlapping epitope(s) on HGF as Ab16.

In a further particularly preferred embodiment of the invention, antibody fragments comprise, or alternatively consist of, Fab (fragment antigen binding) fragments having binding specificity for HGF. With respect to antibody Ab16, the Fab fragment preferably includes the variable heavy chain sequence of SEQ ID NO: 602 and the variable light chain sequence of SEQ ID NO: 622 or sequences that are at least 90% or 95% identical thereto. This embodiment of the invention further includes Fabs containing additions, deletions, and variants of SEQ ID NO: 602 and/or SEQ ID NO: 622 which retain the binding specificity for HGF.

In one embodiment of the invention described herein (infra), Fab fragments may be produced by enzymatic digestion (e.g., papain) of Ab16. In another embodiment of the invention, anti-HGF antibodies such as Ab16 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab16 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab17

In one embodiment, the invention includes antibodies and antibody fragments having binding specificity to HGF that possess a heavy chain sequence comprising the sequence set forth below:

```
                                            (SEQ ID NO: 641)
QSVEESGGRLVPPGTPLTLTCTVSGIDLSSYAMGWVRQAPGKGLEYIGMI

DVSGSTYYADWAKGRLTISKTPTTVDLEITSPTTEDTATYFCARLIDERS

TYSYAFDLWGQGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                            (SEQ ID NO: 642)
QSVEESGGRLVPPGTPLTLTCTVSGIDLSSYAMGWVRQAPGKGLEYIGMI

DVSGSTYYADWAKGRLTISKTPTTVDLEITSPTTEDTATYFCARLIDERS

TYSYAFDLWGQGTLVTVSS.
```

In another embodiment, the invention includes antibodies and antibody fragments having binding specificity to HGF that possess the same epitopic specificity as Ab17 and which contain a constant heavy chain sequence comprising the sequence set forth below:

```
                                            (SEQ ID NO: 650)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                            (SEQ ID NO: 661)
QVLTQTPSPVSAAVGGTVTINCQASQSFYNNGAFSWYQQKPGQPPKLLIY

DASTLASGVPSRFKGSGSGTQFTLTISGVQCGDAATYYCQGEFSCGSADC

VAFGGGTEVVVKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC.
```

In another embodiment, the invention includes antibodies and antibody fragments having binding specificity to HGF that contain a variable light chain sequence comprising the sequence set forth below:

```
                                            (SEQ ID NO: 662)
QVLTQTPSPVSAAVGGTVTINCQASQSFYNNGAFSWYQQKPGQPPKLLIY

DASTLASGVPSRFKGSGSGTQFTLTISGVQCGDAATYYCQGEFSCGSADC

VAFGGGTEVVVKR.
```

In another embodiment, the invention includes antibodies and antibody fragments having binding specificity to HGF that bind the same epitope as Ab17 which contain a constant light chain sequence comprising the sequence set forth below:

```
                                            (SEQ ID NO: 670)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to HGF that contain one, two, or three of the polypeptide sequences of SEQ ID NO: 644; SEQ ID NO: 646; and SEQ ID NO: 648 which correspond to the complementarity-determining regions (CDRs, or hypervariable regions) of the heavy chain sequence of SEQ ID NO: 641 or which contain the variable heavy chain sequence of SEQ ID NO: 642, and/or which further contain one, two, or three of the polypeptide sequences of SEQ ID NO: 664; SEQ ID NO: 666; and SEQ ID NO: 668 which correspond to the complementarity-determining regions (CDRs, or hypervariable regions) of the light chain sequence of SEQ ID NO: 661 or which contain the variable light chain sequence of SEQ ID NO: 662, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 643; SEQ ID NO: 645; SEQ ID NO: 647; and SEQ ID NO: 649 which correspond to the framework regions (FRs or constant regions) of the heavy chain sequence of SEQ ID NO: 641 or the variable heavy chain sequence of SEQ ID NO: 642, and/or one, two, three, or four of the polypeptide sequences of SEQ ID NO: 663; SEQ ID NO: 665; SEQ ID NO: 667; and SEQ ID NO: 669 which correspond to the framework regions (FRs or constant regions) of the light chain sequence of SEQ ID NO: 661 or the variable light chain sequence of SEQ ID NO: 662, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 641 or SEQ ID NO: 642 or polypeptides that are at least 90% or 95% identical thereto. In another embodiment of the invention, antibody fragments of the invention comprise, or alternatively consist of, the polypeptide sequence of SEQ ID NO: 661 or SEQ ID NO: 662 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 644; SEQ ID NO: 646; and SEQ ID NO: 648 which correspond to the complementarity-determining regions (CDRs, or hypervariable regions) of the heavy chain sequence of SEQ ID NO: 641 or the variable heavy chain sequence of SEQ ID NO: 642 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 664; SEQ ID NO: 666; and SEQ ID NO: 668 which correspond to the complementarity-determining regions (CDRs, or hypervariable regions) of the light chain sequence of SEQ ID NO: 661 or the variable light chain sequence of SEQ ID NO: 662 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 643; SEQ ID NO: 645; SEQ ID NO: 647; and SEQ ID NO: 649 which correspond to the framework regions (FRs or constant regions) of the heavy chain sequence of SEQ ID NO: 641 or the variable heavy chain sequence of SEQ ID NO: 642 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 663; SEQ ID NO: 665; SEQ ID NO: 667; and SEQ ID NO: 669 which correspond to the framework regions (FRs or constant regions) of the light chain sequence of SEQ ID NO: 661 or the variable light chain sequence of SEQ ID NO: 662 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 642; the variable light chain region of SEQ ID NO: 662; the complementarity-determining regions (SEQ ID NO: 644; SEQ ID NO: 646; and SEQ ID NO: 648) of the variable heavy chain region of SEQ ID NO: 642; and the complementarity-determining regions (SEQ ID NO: 664; SEQ ID NO: 666; and SEQ ID NO: 668) of the variable light chain region of SEQ ID NO: 662 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 642; the variable light chain region of SEQ ID NO: 662; the framework regions (SEQ ID NO: 643; SEQ ID NO: 645; SEQ ID NO: 647; and SEQ ID NO: 649) of the variable heavy chain region of SEQ ID NO: 642; and the framework regions (SEQ ID NO: 663; SEQ ID NO: 665; SEQ ID NO: 667; and SEQ ID NO: 669) of the variable light chain region of SEQ ID NO: 662.

In a particularly preferred embodiment of the invention, the anti-HGF antibody is Ab17, comprising, or alternatively consisting of, SEQ ID NO: 641 and SEQ ID NO: 661, or an antibody or antibody fragment comprising the CDRs of Ab17 and having at least one of the biological activities set forth herein or is an anti-HGF antibody that competes with Ab17 in binding HGF, preferably one containing sequences that are at least 90% or 95% identical to that of Ab17 or an antibody that binds to the same or overlapping epitope(s) on HGF as Ab17.

In a further particularly preferred embodiment of the invention, antibody fragments comprise, or alternatively consist of, Fab (fragment antigen binding) fragments having binding specificity for HGF. With respect to antibody Ab17, the Fab fragment preferably includes the variable heavy chain sequence of SEQ ID NO: 642 and the variable light chain sequence of SEQ ID NO: 662 or sequences that are at least 90% or 95% identical thereto. This embodiment of the invention further includes Fabs containing additions, deletions, and variants of SEQ ID NO: 642 and/or SEQ ID NO: 662 which retain the binding specificity for HGF.

In one embodiment of the invention described herein (infra), Fab fragments may be produced by enzymatic digestion (e.g., papain) of Ab17. In another embodiment of the invention, anti-HGF antibodies such as Ab17 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab17 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab18

In one embodiment, the invention includes antibodies and antibody fragments having binding specificity to HGF that possess a heavy chain sequence comprising the sequence set forth below:

(SEQ ID NO: 681)
QSLEESGGRLVTPGTPLTLTCTASGFSLSSYDMSWVRQAPGKGLEWIGII

YAGSASTWFASWVKGRFTISKTSTTVDLKMTSLTTEDTATYFCARVGYSG

YGYDDNLDMWGQGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKRVEPKSCDKTHTCPPCPAPELLGGPSVFLFPPKP

KDTLMISRTPEVTCVVVDVSHEDPEVKFNWYVDGVEVHNAKTKPREEQYA

STYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPV

LDSDGSFFLYSKLTVDKSRWQQGNVFSCSVMHEALHNHYTQKSLSLS

PGK.

In one embodiment, the invention includes antibodies and antibody fragments having binding specificity to HGF that contain a variable heavy chain sequence comprising the sequence set forth below:

(SEQ ID NO: 682)
QSLEESGGRLVTPGTPLTLTCTASGFSLSSYDMSWVRQAPGKGLEWIGII

YAGSASTWFASWVKGRFTISKTSTTVDLKMTSLTTEDTATYFCARVGYSG

YGYDDNLDMWGQGTLVTVSS.

In another embodiment, the invention includes antibodies and antibody fragments having binding specificity to HGF that possess the same epitopic specificity as Ab18 and which contain a constant heavy chain sequence comprising the sequence set forth below:

(SEQ ID NO: 690)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 701)
AYDMTQTPASVEVAVGGTVTIKCQASQSISTALAWYQQKPGQRPKLLIYD

ASKLASGVSSRFKGSGSGAQFTLTISGVECADAATYYCHQGYSSSNVDNT

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 702)
AYDMTQTPASVEVAVGGTVTIKCQASQSISTALAWYQQKPGQRPKLLIYD

ASKLASGVSSRFKGSGSGAQFTLTISGVECADAATYYCHQGYSSSNVDNT

FGGGTEVVVKR.

In another embodiment, the invention includes antibodies and antibody fragments having binding specificity to HGF that bind the same epitope as Ab18 which contain a constant light chain sequence comprising the sequence set forth below:

(SEQ ID NO: 710)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 684; SEQ ID NO: 686; and SEQ ID NO: 688 which correspond to the complementarity-determining regions (CDRs, or hypervariable regions) of the heavy chain sequence of SEQ ID NO: 681 or which contain the variable heavy chain sequence of SEQ ID NO: 682, and/or which further contain one, two, or three of the polypeptide sequences of SEQ ID NO: 704; SEQ ID NO: 706; and SEQ ID NO: 708 which correspond to the complementarity-determining regions (CDRs, or hypervariable regions) of the light chain sequence of SEQ ID NO: 701 or which contain the variable light chain sequence of SEQ ID NO: 702, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 683; SEQ ID NO: 685; SEQ ID NO: 687; and SEQ ID NO: 689 which correspond to the framework regions (FRs or constant regions) of the heavy chain sequence of SEQ ID NO: 681 or the variable heavy chain sequence of SEQ ID NO: 682, and/or one, two, three, or four of the polypeptide sequences of SEQ ID NO: 703; SEQ ID NO: 705; SEQ ID NO: 707; and SEQ ID NO: 709 which correspond to the framework regions (FRs or constant regions) of the light chain sequence of SEQ ID NO: 701 or the variable light chain sequence of SEQ ID NO: 702, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 681 or SEQ ID NO: 682 or polypeptides that are at least 90% or 95% identical thereto. In another embodiment of the invention, antibody fragments of the invention comprise, or alternatively consist of, the polypeptide sequence of SEQ ID NO: 701 or SEQ ID NO: 702 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 684; SEQ ID NO: 686; and SEQ ID NO: 688 which correspond to the complementarity-determining regions (CDRs, or hypervariable regions) of the heavy chain sequence of SEQ ID NO: 681 or the variable heavy chain sequence of SEQ ID NO: 682 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 704; SEQ ID NO: 706; and SEQ ID NO: 708 which correspond to the complementarity-determining regions (CDRs, or hypervariable regions) of the light chain sequence of SEQ ID NO: 701 or the variable light chain sequence of SEQ ID NO: 702 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 683; SEQ ID NO: 685; SEQ ID NO: 687; and SEQ ID NO: 689 which correspond to the framework regions (FRs or constant regions) of the heavy chain sequence of SEQ ID NO: 681 or the variable heavy chain sequence of SEQ ID NO: 682 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 703; SEQ ID NO: 705; SEQ ID NO: 707; and SEQ ID NO: 709 which correspond to the framework regions (FRs or constant regions) of the light chain sequence of SEQ ID NO: 701 or the variable light chain sequence of SEQ ID NO: 702 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 682; the variable light chain region of SEQ ID NO: 702; the complementarity-determining regions (SEQ ID NO: 684; SEQ ID NO: 686; and SEQ ID NO: 688) of the variable heavy chain region of SEQ ID NO: 682; and the complementarity-determining regions (SEQ ID NO: 704; SEQ ID NO: 706; and SEQ ID NO: 708) of the variable light chain region of SEQ ID NO: 702 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 682; the variable light chain region of SEQ ID NO: 702; the framework regions (SEQ ID NO: 683; SEQ ID NO: 685; SEQ ID NO: 687; and SEQ ID NO: 689) of the variable heavy chain region of SEQ ID NO: 682; and the framework regions (SEQ ID NO: 703; SEQ ID NO: 705; SEQ ID NO: 707; and SEQ ID NO: 709) of the variable light chain region of SEQ ID NO: 702.

In a particularly preferred embodiment of the invention, the anti-HGF antibody is Ab18, comprising, or alternatively consisting of, SEQ ID NO: 681 and SEQ ID NO: 701, or an antibody or antibody fragment comprising the CDRs of Ab18 and having at least one of the biological activities set forth herein or is an anti-HGF antibody that competes with Ab18 in binding HGF, preferably one containing sequences that are at least 90% or 95% identical to that of Ab18 or an antibody that binds to the same or overlapping epitope(s) on HGF as Ab18.

In a further particularly preferred embodiment of the invention, antibody fragments comprise, or alternatively consist of, Fab (fragment antigen binding) fragments having binding specificity for HGF. With respect to antibody Ab18, the Fab fragment preferably includes the variable heavy chain sequence of SEQ ID NO: 682 and the variable light chain sequence of SEQ ID NO: 702 or sequences that are at least 90% or 95% identical thereto. This embodiment of the invention further includes Fabs containing additions, deletions, and variants of SEQ ID NO: 682 and/or SEQ ID NO: 702 which retain the binding specificity for HGF.

In one embodiment of the invention described herein (infra), Fab fragments may be produced by enzymatic digestion (e.g., papain) of Ab18. In another embodiment of the invention, anti-HGF antibodies such as Ab18 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab18 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab19

In one embodiment, the invention includes antibodies and antibody fragments having binding specificity to HGF that possess a heavy chain sequence comprising the sequence set forth below:

(SEQ ID NO: 721)
QSVEESGGRLVTPGTPLTLTCTASGFSLSNYWMGWVRQAPGEGLEWIGTI

SYDGNTYYASWAKGRFTISRTSTTVDLKMTSLTTEDTAIYFCATVNYPDY

STGAFNIWGPGTLVTVSSASTKGPSVFPLAPSSKSTSGGTAALGCLVKDY

-continued
FPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKD

TLMISRTPEVTCVVVDVSHEDPEVKFNWYVDGVEVHNAKTKPREEQYAST

YRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 722)
QSVEESGGRLVTPGTPLTLTCTASGFSLSNYWMGWVRQAPGEGLEWIGT

ISYDGNTYYASWAKGRFTISRTSTTVDLKMTSLTTEDTAIYFCATVNYP

DYSTGAFNIWGPGTLVTVSS.

In another embodiment, the invention includes antibodies and antibody fragments having binding specificity to HGF that possess the same epitopic specificity as Ab19 and which contain a constant heavy chain sequence comprising the sequence set forth below:

(SEQ ID NO: 730)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 741)
DVVMTQTPASVSEPVGGTVTIKCQASQSIDNYLAWYQQKPGQRPRLLIY

YTSTLASGVPSRFKGSGSGTEYTLTISDLECADAATYYCQFTAYYSTYI

GAFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYA

CEVTHQGLSSPVTKSFNRGEC.

In another embodiment, the invention includes antibodies and antibody fragments having binding specificity to HGF that contain a variable light chain sequence comprising the sequence set forth below:

(SEQ ID NO: 742)
DVVMTQTPASVSEPVGGTVTIKCQASQSIDNYLAWYQQKPGQRPRLLIY

YTSTLASGVPSRFKGSGSGTEYTLTISDLECADAATYYCQFTAYYSTYI

GAFGGGTEVVVKR.

In another embodiment, the invention includes antibodies and antibody fragments having binding specificity to HGF that bind the same epitope as Ab19 which contain a constant light chain sequence comprising the sequence set forth below:

(SEQ ID NO: 750)
TVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVT

KSFNRGEC.

In another embodiment, the invention includes antibodies and antibody fragments having binding specificity to HGF that contain one, two, or three of the polypeptide sequences of SEQ ID NO: 724; SEQ ID NO: 726; and SEQ ID NO: 728 which correspond to the complementarity-determining regions (CDRs, or hypervariable regions) of the heavy chain sequence of SEQ ID NO: 721 or which contain the variable heavy chain sequence of SEQ ID NO: 722, and/or which further contain one, two, or three of the polypeptide sequences of SEQ ID NO: 744; SEQ ID NO: 746; and SEQ ID NO: 748 which correspond to the complementarity-determining regions (CDRs, or hypervariable regions) of the light chain sequence of SEQ ID NO: 741 or which contain the variable light chain sequence of SEQ ID NO: 742, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 723; SEQ ID NO: 725; SEQ ID NO: 727; and SEQ ID NO: 729 which correspond to the framework regions (FRs or constant regions) of the heavy chain sequence of SEQ ID NO: 721 or the variable heavy chain sequence of SEQ ID NO: 722, and/or one, two, three, or four of the polypeptide sequences of SEQ ID NO: 743; SEQ ID NO: 745; SEQ ID NO: 747; and SEQ ID NO: 749 which correspond to the framework regions (FRs or constant regions) of the light chain sequence of SEQ ID NO: 741 or the variable light chain sequence of SEQ ID NO: 742, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 721 or SEQ ID NO: 722 or polypeptides that are at least 90% or 95% identical thereto. In another embodiment of the invention, antibody fragments of the invention comprise, or alternatively consist of, the polypeptide sequence of SEQ ID NO: 741 or SEQ ID NO: 742 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 724; SEQ ID NO: 726; and SEQ ID NO: 728 which correspond to the complementarity-determining regions (CDRs, or hypervariable regions) of the heavy chain sequence of SEQ ID NO: 721 or the variable heavy chain sequence of SEQ ID NO: 722 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 744; SEQ ID NO: 746; and SEQ ID NO: 748 which correspond to the complementarity-determining regions (CDRs, or hypervariable regions) of the light chain sequence of SEQ ID NO: 741 or the variable light chain sequence of SEQ ID NO: 742 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 723; SEQ ID NO: 725; SEQ ID NO: 727; and SEQ ID NO: 729 which correspond to the framework regions (FRs or constant regions) of the heavy chain sequence of SEQ ID NO: 721 or the variable heavy chain sequence of SEQ ID NO: 722 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 743; SEQ ID NO: 745; SEQ ID NO: 747; and SEQ ID NO: 749 which correspond to the framework regions (FRs or constant regions) of the light chain sequence of SEQ ID NO: 741 or the variable light chain sequence of SEQ ID NO: 742 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 722; the variable light chain region of SEQ ID NO: 742; the complementarity-determining regions (SEQ ID NO: 724; SEQ ID NO: 726; and SEQ ID NO: 728) of the variable heavy chain region of SEQ ID NO: 722; and the complementarity-determining regions (SEQ ID NO: 744; SEQ ID NO: 746; and SEQ ID NO: 748) of the variable light chain region of SEQ ID NO: 742 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 722; the variable light chain region of SEQ ID NO: 742; the framework regions (SEQ ID NO: 723; SEQ ID NO: 725; SEQ ID NO: 727; and SEQ ID NO: 729) of the variable heavy chain region of SEQ ID NO: 722; and the framework regions (SEQ ID NO: 743; SEQ ID NO: 745; SEQ ID NO: 747; and SEQ ID NO: 749) of the variable light chain region of SEQ ID NO: 742.

In a particularly preferred embodiment of the invention, the anti-HGF antibody is Ab19, comprising, or alternatively consisting of, SEQ ID NO: 721 and SEQ ID NO: 741, or an antibody or antibody fragment comprising the CDRs of Ab19 and having at least one of the biological activities set forth herein or is an anti-HGF antibody that competes with Ab19 in binding HGF, preferably one containing sequences that are at least 90% or 95% identical to that of Ab19 or an antibody that binds to the same or overlapping epitope(s) on HGF as Ab19.

In a further particularly preferred embodiment of the invention, antibody fragments comprise, or alternatively consist of, Fab (fragment antigen binding) fragments having binding specificity for HGF. With respect to antibody Ab19, the Fab fragment preferably includes the variable heavy chain sequence of SEQ ID NO: 722 and the variable light chain sequence of SEQ ID NO: 742 or sequences that are at least 90% or 95% identical thereto. This embodiment of the invention further includes Fabs containing additions, deletions, and variants of SEQ ID NO: 722 and/or SEQ ID NO: 742 which retain the binding specificity for HGF.

In one embodiment of the invention described herein (infra), Fab fragments may be produced by enzymatic digestion (e.g., papain) of Ab19. In another embodiment of the invention, anti-HGF antibodies such as Ab19 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab19 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab20

In one embodiment, the invention includes antibodies and antibody fragments having binding specificity to HGF that possess a heavy chain sequence comprising the sequence set forth below:

```
                                              (SEQ ID NO: 761)
EVQLVESGGGLVQPGGSLRLSCAASGFTVSNYWMGWVRQAPGKGLEWIG

TISYDGNTYYASSAKGRFTISRDNSKNTLYLQMNSLRAEDTAVYYCATV

NYPDYSTGAFNIWGQGTLVTVSSASTKGPSVFPLAPSSKSTSGGTAALG

CLVKDYFPEPVTVSWNSGALTSGVHTFPAVLQSSGLYSLSSVVTVPSSS

LGTQTYICNVNHKPSNTKVDKRVEPKSCDKTHTCPPCPAPELLGGPSVF

LFPPKPKDTLMISRTPEVTCVVVDVSHEDPEVKFNWYVDGVEVHNAKTK

PREEQYASTYRVVSVLTVLHQDWLNGKEYKCKVSNKALPAPIEKTISKA

KGQPREPQVYTLPPSREEMTKNQVSLTCLVKGFYPSDIAVEWESNGQPE

NNYKTTPPVLDSDGSFFLYSKLTVDKSRWQQGNVFSCSVMHEALHNHYT

QKSLSLSPGK.
```

In one embodiment, the invention includes antibodies and antibody fragments having binding specificity to HGF that contain a variable heavy chain sequence comprising the sequence set forth below:

(SEQ ID NO: 762)
EVQLVESGGGLVQPGGSLRLSCAASGFTVSNYWMGWVRQAPGKGLEWIG

TISYDGNTYYASSAKGRFTISRDNSKNTLYLQMNSLRAEDTAVYYCATV

NYPDYSTGAFNIWGQGTLVTVSS.

In another embodiment, the invention includes antibodies and antibody fragments having binding specificity to HGF that possess the same epitopic specificity as Ab20 and which contain a constant heavy chain sequence comprising the sequence set forth below:

(SEQ ID NO: 770)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 781)
DIQMTQSPSSLSASVGDRVTITCQASQSIDNYLAWYQQKPGKVPKLLIY

YTSTLASGVPSRFSGSGSGTDFTLTISSLQPEDVATYYCQFTAYYSTYI

GAFGGGTKVEIKRTVAAPSVFIFPPSDEQLKSGTASVVCLLNNFYPREA

KVQWKVDNALQSGNSQESVTEQDSKDSTYSLSSTLTLSKADYEKHKVYA

CEVTHQGLSSPVTKSFNRGEC.

In another embodiment, the invention includes antibodies and antibody fragments having binding specificity to HGF that contain a variable light chain sequence comprising the sequence set forth below:

(SEQ ID NO: 782)
DIQMTQSPSSLSASVGDRVTITCQASQSIDNYLAWYQQKPGKVPKLLIY

YTSTLASGVPSRFSGSGSGTDFTLTISSLQPEDVATYYCQFTAYYSTYI

GAFGGGTKVEIKR.

In another embodiment, the invention includes antibodies and antibody fragments having binding specificity to HGF that bind the same epitope as Ab20 which contain a constant light chain sequence comprising the sequence set forth below:

(SEQ ID NO: 790)
TVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVT

KSFNRGEC.

In another embodiment, the invention includes antibodies and antibody fragments having binding specificity to HGF that contain one, two, or three of the polypeptide sequences of SEQ ID NO: 764; SEQ ID NO: 766; and SEQ ID NO: 768 which correspond to the complementarity-determining regions (CDRs, or hypervariable regions) of the heavy chain sequence of SEQ ID NO: 761 or which contain the variable heavy chain sequence of SEQ ID NO: 762, and/or which further contain one, two, or three of the polypeptide sequences of SEQ ID NO: 784; SEQ ID NO: 786; and SEQ ID NO: 788 which correspond to the complementarity-determining regions (CDRs, or hypervariable regions) of the light chain sequence of SEQ ID NO: 781 or which contain the variable light chain sequence of SEQ ID NO: 782, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 763; SEQ ID NO: 765; SEQ ID NO: 767; and SEQ ID NO: 769 which correspond to the framework regions (FRs or constant regions) of the heavy chain sequence of SEQ ID NO: 761 or the variable heavy chain sequence of SEQ ID NO: 762, and/or one, two, three, or four of the polypeptide sequences of SEQ ID NO: 783; SEQ ID NO: 785; SEQ ID NO: 787; and SEQ ID NO: 789 which correspond to the framework regions (FRs or constant regions) of the light chain sequence of SEQ ID NO: 781 or the variable light chain sequence of SEQ ID NO: 782, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 761 or SEQ ID NO: 762 or polypeptides that are at least 90% or 95% identical thereto. In another embodiment of the invention, antibody fragments of the invention comprise, or alternatively consist of, the polypeptide sequence of SEQ ID NO: 781 or SEQ ID NO: 782 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 764; SEQ ID NO: 766; and SEQ ID NO: 768 which correspond to the complementarity-determining regions (CDRs, or hypervariable regions) of the heavy chain sequence of SEQ ID NO: 761 or the variable heavy chain sequence of SEQ ID NO: 762 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 784; SEQ ID NO: 786; and SEQ ID NO: 788 which correspond to the complementarity-determining regions (CDRs, or hypervariable regions) of the light chain sequence of SEQ ID NO: 781 or the variable light chain sequence of SEQ ID NO: 782 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 763; SEQ ID NO: 765; SEQ ID NO: 767; and SEQ ID NO: 769 which correspond to the framework regions (FRs or constant regions) of the heavy chain sequence of SEQ ID NO: 761 or the variable heavy chain sequence of SEQ ID NO: 762 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 783; SEQ ID NO: 785; SEQ ID NO: 787; and SEQ ID NO: 789 which correspond to the framework regions (FRs or constant regions) of the light chain sequence of SEQ ID NO: 781 or the variable light chain sequence of SEQ ID NO: 782 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 762; the variable light chain region of SEQ ID NO: 782; the complementarity-determining regions (SEQ ID NO: 764; SEQ ID NO: 766; and SEQ ID NO: 768) of the variable heavy chain region of SEQ ID NO: 762; and the complementarity-determining regions (SEQ ID NO: 784; SEQ ID NO: 786; and SEQ ID NO: 788) of the variable light chain region of SEQ ID NO: 782 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 762; the variable light chain region of SEQ ID NO: 782; the framework regions (SEQ ID NO: 763; SEQ ID NO: 765; SEQ ID NO: 767; and SEQ ID NO: 769) of the variable heavy chain region of SEQ ID NO: 762; and the framework regions (SEQ ID NO: 783; SEQ ID NO: 785; SEQ ID NO: 787; and SEQ ID NO: 789) of the variable light chain region of SEQ ID NO: 782.

In a particularly preferred embodiment of the invention, the anti-HGF antibody is Ab20, comprising, or alternatively consisting of, SEQ ID NO: 761 and SEQ ID NO: 781, or an antibody or antibody fragment comprising the CDRs of Ab20 and having at least one of the biological activities set forth herein or is an anti-HGF antibody that competes with Ab20 in binding HGF, preferably one containing sequences that are at least 90% or 95% identical to that of Ab20 or an antibody that binds to the same or overlapping epitope(s) on HGF as Ab20.

In a further particularly preferred embodiment of the invention, antibody fragments comprise, or alternatively consist of, Fab (fragment antigen binding) fragments having binding specificity for HGF. With respect to antibody Ab20, the Fab fragment preferably includes the variable heavy chain sequence of SEQ ID NO: 762 and the variable light chain sequence of SEQ ID NO: 782 or sequences that are at least 90% or 95% identical thereto. This embodiment of the invention further includes Fabs containing additions, deletions, and variants of SEQ ID NO: 762 and/or SEQ ID NO: 782 which retain the binding specificity for HGF.

In one embodiment of the invention described herein (infra), Fab fragments may be produced by enzymatic digestion (e.g., papain) of Ab20. In another embodiment of the invention, anti-HGF antibodies such as Ab20 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab20 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab21

In one embodiment, the invention includes antibodies and antibody fragments having binding specificity to HGF that possess a heavy chain sequence comprising the sequence set forth below:

(SEQ ID NO: 801)
QSVEESGGRLVTPGTPLTLTCTVSGFSLSTYYMSWVRQAPGKGLEWIGI

IYVSGITDYARWAKGRFTISKTSTTVDLKMTSLTTEDTATYFCARHIDS

SGWDGLGIWGQGTLVTVSSASTKGPSVFPLAPSSKSTSGGTAALGCLVK

DYFPEPVTVSWNSGALTSGVHTFPAVLQSSGLYSLSSVVTVPSSSLGTQ

TYICNVNHKPSNTKVDKRVEPKSCDKTHTCPPCPAPELLGGPSVFLFPP

KPKDTLMISRTPEVTCVVVDVSHEDPEVKFNWYVDGVEVHNAKTKPREE

QYASTYRVVSVLTVLHQDWLNGKEYKCKVSNKALPAPIEKTISKAKGQP

REPQVYTLPPSREEMTKNQVSLTCLVKGFYPSDIAVEWESNGQPENNYK

TTPPVLDSDGSFFLYSKLTVDKSRWQQGNVFSCSVMHEALHNHYTQKSL

SLSPGK.

In one embodiment, the invention includes antibodies and antibody fragments having binding specificity to HGF that contain a variable heavy chain sequence comprising the sequence set forth below:

(SEQ ID NO: 802)
QSVEESGGRLVTPGTPLTLTCTVSGFSLSTYYMSWVRQAPGKGLEWIGH

YVSGITDYARWAKGRFTISKTSTTVDLKMTSLTTEDTATYFCARHIDSS

GWDGLGIWGQGTLVTVSS.

In another embodiment, the invention includes antibodies and antibody fragments having binding specificity to HGF that possess the same epitopic specificity as Ab21 and which contain a constant heavy chain sequence comprising the sequence set forth below:

(SEQ ID NO: 810)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 821)
AYDMTQTPASVEVAVGGTVTIKCQASESISSYLNWYQQKLGQPPKLLIY

RASTLTSGVSSRFKGSGSGTEYTLTISDLECADAATYYCQQTYGYSDTD

NSFGGGTEVVVKRTVAAPSVFIFPPSDEQLKSGTASVVCLLNNFYPREA

KVQWKVDNALQSGNSQESVTEQDSKDSTYSLSSTLTLSKADYEKHKVYA

CEVTHQGLSSPVTKSFNRGEC.

In another embodiment, the invention includes antibodies and antibody fragments having binding specificity to HGF that contain a variable light chain sequence comprising the sequence set forth below:

(SEQ ID NO: 822)
AYDMTQTPASVEVAVGGTVTIKCQASESISSYLNWYQQKLGQPPKLLIYR

ASTLTSGVSSRFKGSGSGTEYTLTISDLECADAATYYCQQTYGYSDTDNS

FGGGTEVVVKR.

In another embodiment, the invention includes antibodies and antibody fragments having binding specificity to HGF that bind the same epitope as Ab21 which contain a constant light chain sequence comprising the sequence set forth below:

(SEQ ID NO: 830)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 804; SEQ ID NO: 806; and SEQ ID NO: 808 which correspond to the complementarity-determining regions (CDRs, or hypervariable regions) of the heavy chain sequence of SEQ ID NO: 801 or which contain the variable heavy chain sequence of SEQ ID NO: 802, and/or which further contain one, two, or three of the polypeptide sequences of SEQ ID NO: 824; SEQ ID NO: 826; and SEQ ID NO: 828 which correspond to the complementarity-determining regions (CDRs, or hypervariable regions) of the light chain sequence of SEQ ID NO: 821 or which contain the variable light chain sequence of SEQ ID NO: 822, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 803; SEQ ID NO: 805; SEQ ID NO: 807; and SEQ ID NO: 809 which correspond to the framework regions (FRs or constant regions) of the heavy chain sequence of SEQ ID NO: 801 or the variable heavy chain sequence of SEQ ID NO: 802, and/or one, two, three, or four of the polypeptide sequences of SEQ ID NO: 823; SEQ ID NO: 825; SEQ ID NO: 827; and SEQ ID NO: 829 which correspond to the framework regions (FRs or constant regions) of the light chain sequence of SEQ ID NO: 821 or the variable light chain sequence of SEQ ID NO: 822, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 801 or SEQ ID NO: 802 or polypeptides that are at least 90% or 95% identical thereto. In another embodiment of the invention, antibody fragments of the invention comprise, or alternatively consist of, the polypeptide sequence of SEQ ID NO: 821 or SEQ ID NO: 822 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 804; SEQ ID NO: 806; and SEQ ID NO: 808 which correspond to the complementarity-determining regions (CDRs, or hypervariable regions) of the heavy chain sequence of SEQ ID NO: 801 or the variable heavy chain sequence of SEQ ID NO: 802 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 824; SEQ ID NO: 826; and SEQ ID NO: 828 which correspond to the complementarity-determining regions (CDRs, or hypervariable regions) of the light chain sequence of SEQ ID NO: 821 or the variable light chain sequence of SEQ ID NO: 822 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 803; SEQ ID NO: 805; SEQ ID NO: 807; and SEQ ID NO: 809 which correspond to the framework regions (FRs or constant regions) of the heavy chain sequence of SEQ ID NO: 801 or the variable heavy chain sequence of SEQ ID NO: 802 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 823; SEQ ID NO: 825; SEQ ID NO: 827; and SEQ ID NO: 829 which correspond to the framework regions (FRs or constant regions) of the light chain sequence of SEQ ID NO: 821 or the variable light chain sequence of SEQ ID NO: 822 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 802; the variable light chain region of SEQ ID NO: 822; the complementarity-determining regions (SEQ ID NO: 804; SEQ ID NO: 806; and SEQ ID NO: 808) of the variable heavy chain region of SEQ ID NO: 802; and the complementarity-determining regions (SEQ ID NO: 824; SEQ ID NO: 826; and SEQ ID NO: 828) of the variable light chain region of SEQ ID NO: 822 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 802; the variable light chain region of SEQ ID NO: 822; the framework regions (SEQ ID NO: 803; SEQ ID NO: 805; SEQ ID NO: 807; and SEQ ID NO: 809) of the variable heavy chain region of SEQ ID NO: 802; and the framework regions (SEQ ID NO: 823; SEQ ID NO: 825; SEQ ID NO: 827; and SEQ ID NO: 829) of the variable light chain region of SEQ ID NO: 822.

In a particularly preferred embodiment of the invention, the anti-HGF antibody is Ab21, comprising, or alternatively consisting of, SEQ ID NO: 801 and SEQ ID NO: 821, or an antibody or antibody fragment comprising the CDRs of Ab21 and having at least one of the biological activities set forth herein or is an anti-HGF antibody that competes with Ab21 in binding HGF, preferably one containing sequences that are at least 90% or 95% identical to that of Ab21 or an antibody that binds to the same or overlapping epitope(s) on HGF as Ab21.

In a further particularly preferred embodiment of the invention, antibody fragments comprise, or alternatively consist of, Fab (fragment antigen binding) fragments having binding specificity for HGF. With respect to antibody Ab21, the Fab fragment preferably includes the variable heavy chain sequence of SEQ ID NO: 802 and the variable light chain sequence of SEQ ID NO: 822 or sequences that are at least 90% or 95% identical thereto. This embodiment of the invention further includes Fabs containing additions, deletions, and variants of SEQ ID NO: 802 and/or SEQ ID NO: 822 which retain the binding specificity for HGF.

In one embodiment of the invention described herein (infra), Fab fragments may be produced by enzymatic digestion (e.g., papain) of Ab21. In another embodiment of the invention, anti-HGF antibodies such as Ab21 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab21 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab23

In one embodiment, the invention includes antibodies and antibody fragments having binding specificity to HGF that possess a heavy chain sequence comprising the sequence set forth below:

(SEQ ID NO: 841)
QSLEESGGRLVTPGTPLTLTCTASGFTIGRYYMSWVRQAPGKGLEWIGII

YTHGVNPDYASWAKGRFTISRPSTTVDLKITSPTTEDTATYFCARVGGFN

DYSDIWGPGTLVTVSSASTKGPSVFPLAPSSKSTSGGTAALGCLVKDYFP

EPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTL

MISRTPEVTCVVVDVSHEDPEVKFNWYVDGVEVHNAKTKPREEQYASTYR

VVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSD

GSFFLYSKLTVDKSRWQQGNVFSCSVMHEALHNHYTQKSLSLSPG

K.

In one embodiment, the invention includes antibodies and antibody fragments having binding specificity to HGF that contain a variable heavy chain sequence comprising the sequence set forth below:

(SEQ ID NO: 842)
QSLEESGGRLVTPGTPLTLTCTASGFTIGRYYMSWVRQAPGKGLEWIGII

YTHGVNPDYASWAKGRFTISRPSTTVDLKITSPTTEDTATYFCARVGGFN

DYSDIWGPGTLVTVSS.

In another embodiment, the invention includes antibodies and antibody fragments having binding specificity to HGF that possess the same epitopic specificity as Ab23 and which contain a constant heavy chain sequence comprising the sequence set forth below:

(SEQ ID NO: 850)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 861)
AYDMTQTPASVEVAVGGTVTIKCQASESISTYLAWYQQKPGQPPKLLIYR

ASTLASGVSSRFKGSGSGTQFTLTISGVECADAATYYCQQGYSYSNVDNA

FGGGTEVVVKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 862)
AYDMTQTPASVEVAVGGTVTIKCQASESISTYLAWYQQKPGQPPKLLIYR

ASTLASGVSSRFKGSGSGTQFTLTISGVECADAATYYCQQGYSYSNVDNA

FGGGTEVVVKR.

In another embodiment, the invention includes antibodies and antibody fragments having binding specificity to HGF that bind the same epitope as Ab23 which contain a constant light chain sequence comprising the sequence set forth below:

(SEQ ID NO: 870)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 844; SEQ ID NO: 846; and SEQ ID NO: 848 which correspond to the complementarity-determining regions (CDRs, or hypervariable regions) of the heavy chain sequence of SEQ ID NO: 841 or which contain the variable heavy chain sequence of SEQ ID NO: 842, and/or which further contain one, two, or three of the polypeptide sequences of SEQ ID NO: 864; SEQ ID NO: 866; and SEQ ID NO: 868 which correspond to the complementarity-determining regions (CDRs, or hypervariable regions) of the light chain sequence of SEQ ID NO: 861 or which contain the variable light chain sequence of SEQ ID NO: 862, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 843; SEQ ID NO: 845; SEQ ID NO: 847; and SEQ ID NO: 849 which correspond to the framework regions (FRs or constant regions) of the heavy chain sequence of SEQ ID NO: 841 or the variable heavy chain sequence of SEQ ID NO: 842, and/or one, two, three, or four of the polypeptide sequences of SEQ ID NO: 863; SEQ ID NO: 865; SEQ ID NO: 867; and SEQ ID NO: 869 which correspond to the framework regions (FRs or constant regions) of the light chain sequence of SEQ ID NO: 861 or the variable light chain sequence of SEQ ID NO: 862, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 841 or SEQ ID NO: 842 or polypeptides that are at least 90% or 95% identical thereto. In another embodiment of the invention, antibody fragments of the invention comprise, or alternatively consist of, the polypeptide sequence of SEQ ID NO: 861 or SEQ ID NO: 862 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 844; SEQ ID NO: 846; and SEQ ID NO: 848 which correspond to the complementarity-determining regions (CDRs, or hypervariable regions) of the heavy chain sequence of SEQ ID NO: 841 or the variable heavy chain sequence of SEQ ID NO: 842 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 864; SEQ ID NO: 866; and SEQ ID NO: 868 which correspond to the complementarity-determining regions (CDRs, or hypervariable regions) of the light chain sequence of SEQ ID NO: 861 or the variable light chain sequence of SEQ ID NO: 862 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 843; SEQ ID NO: 845; SEQ ID NO: 847; and SEQ ID NO: 849 which correspond to the framework regions (FRs or constant regions) of the heavy chain sequence of SEQ ID NO: 841 or the variable heavy chain sequence of SEQ ID NO: 842 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 863; SEQ ID NO: 865; SEQ ID NO: 867; and SEQ ID NO: 869 which correspond to the framework regions (FRs or constant regions) of the light chain sequence of SEQ ID NO: 861 or the variable light chain sequence of SEQ ID NO: 862 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 842; the variable light chain region of SEQ ID NO: 862; the complementarity-determining regions (SEQ ID NO: 844; SEQ ID NO: 846; and SEQ ID NO: 848) of the variable heavy chain region of SEQ ID NO: 842; and the complementarity-determining regions (SEQ ID NO: 864; SEQ ID NO: 866; and SEQ ID NO: 868) of the variable light chain region of SEQ ID NO: 862 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 842; the variable light chain region of SEQ ID NO: 862; the framework regions (SEQ ID NO: 843; SEQ ID NO: 845; SEQ ID NO: 847; and SEQ ID NO: 849) of the variable heavy chain region of SEQ ID NO: 842; and the framework regions (SEQ ID NO: 863; SEQ ID NO: 865; SEQ ID NO: 867; and SEQ ID NO: 869) of the variable light chain region of SEQ ID NO: 862.

In a particularly preferred embodiment of the invention, the anti-HGF antibody is Ab23, comprising, or alternatively consisting of, SEQ ID NO: 841 and SEQ ID NO: 861, or an antibody or antibody fragment comprising the CDRs of Ab23 and having at least one of the biological activities set forth herein or is an anti-HGF antibody that competes with Ab23 in binding HGF, preferably one containing sequences that are at least 90% or 95% identical to that of Ab23 or an antibody that binds to the same or overlapping epitope(s) on HGF as Ab23.

In a further particularly preferred embodiment of the invention, antibody fragments comprise, or alternatively consist of, Fab (fragment antigen binding) fragments having binding specificity for HGF. With respect to antibody Ab23, the Fab fragment preferably includes the variable heavy chain sequence of SEQ ID NO: 842 and the variable light chain sequence of SEQ ID NO: 862 or sequences that are at least 90% or 95% identical thereto. This embodiment of the invention further includes Fabs containing additions, deletions, and variants of SEQ ID NO: 842 and/or SEQ ID NO: 862 which retain the binding specificity for HGF.

In one embodiment of the invention described herein (infra), Fab fragments may be produced by enzymatic digestion (e.g., papain) of Ab23. In another embodiment of the invention, anti-HGF antibodies such as Ab23 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab23 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab24

In one embodiment, the invention includes antibodies and antibody fragments having binding specificity to HGF that possess a heavy chain sequence comprising the sequence set forth below:

(SEQ ID NO: 881)
EVQLVESGGGLVQPGGSLRLSCAASGFTVGRYYMSWVRQAPGKGLEWIGI

IYTHGVNPDYASSAKGRFTISRDNSKNTLYLQMNSLRAEDTAVYYCARVG

GFNDYSDIWGQGTLVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKRVEPKSCDKTHTCPPCPAPELLGGPSVFLFPPKPK

DTLMISRTPEVTCVVVDVSHEDPEVKFNWYVDGVEVHNAKTKPREEQYAS

TYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVL

DSDGSFFLYSKLTVDKSRWQQGNVFSCSVMHEALHNHYTQKSLSLSPGK.

In one embodiment, the invention includes antibodies and antibody fragments having binding specificity to HGF that contain a variable heavy chain sequence comprising the sequence set forth below:

(SEQ ID NO: 882)
EVQLVESGGGLVQPGGSLRLSCAASGFTVGRYYMSWVRQAPGKGLEWIGI

IYTHGVNPDYASSAKGRFTISRDNSKNTLYLQMNSLRAEDTAVYYCARVG

GFNDYSDIWGQGTLVTVSS.

In another embodiment, the invention includes antibodies and antibody fragments having binding specificity to HGF that possess the same epitopic specificity as Ab24 and which contain a constant heavy chain sequence comprising the sequence set forth below:

(SEQ ID NO: 890)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 901)
DIQMTQSPSSLSASVGDRVTITCQASESISTYLAWYQQKPGKVPKLLIYR

ASTLASGVPSRFSGSGSGTDFTLTISSLQPEDVATYYCQQGYSYSNVDNA

FGGGTKVEIKRTVAAPSVFIFPPSDEQLKSGTASVVCLLNNFYPREAKVQ

WKVDNALQSGNSQESVTEQDSKDSTYSLSSTLTLSKADYEKHKVYACEVT

HQGLSSPVTKSFNRGEC.

In another embodiment, the invention includes antibodies and antibody fragments having binding specificity to HGF that contain a variable light chain sequence comprising the sequence set forth below:

(SEQ ID NO: 902)
DIQMTQSPSSLSASVGDRVTITCQASESISTYLAWYQQKPGKVPKLLIYR

ASTLASGVPSRFSGSGSGTDFTLTISSLQPEDVATYYCQQGYSYSNVDNA

FGGGTKVEIKR.

In another embodiment, the invention includes antibodies and antibody fragments having binding specificity to HGF that bind the same epitope as Ab24 which contain a constant light chain sequence comprising the sequence set forth below:

(SEQ ID NO: 910)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 884; SEQ ID NO: 886; and SEQ ID NO: 888 which correspond to the complementarity-determining regions (CDRs, or hypervariable regions) of the heavy chain sequence of SEQ ID NO: 881 or which contain the variable heavy chain sequence of SEQ ID NO: 882, and/or which further contain one, two, or three of the polypeptide sequences of SEQ ID NO: 904; SEQ ID NO: 906; and SEQ ID NO: 908 which correspond to the complementarity-determining regions (CDRs, or hypervariable regions) of the light chain sequence of SEQ ID NO: 901 or which contain the variable light chain sequence of SEQ ID NO: 902, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 883; SEQ ID NO: 885; SEQ ID NO: 887; and SEQ ID NO: 889 which correspond to the framework regions (FRs or constant regions) of the heavy chain sequence of SEQ ID NO: 881 or the variable heavy chain sequence of SEQ ID NO: 882, and/or one, two, three, or four of the polypeptide sequences of SEQ ID NO: 903; SEQ ID NO: 905; SEQ ID NO: 907; and SEQ ID NO: 909 which correspond to the framework regions (FRs or constant regions) of the light chain sequence of SEQ ID NO: 901 or the variable light chain sequence of SEQ ID NO: 902, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 881 or SEQ ID NO: 882 or polypeptides that are at least 90% or 95% identical thereto. In another embodiment of the invention, antibody fragments of the invention comprise, or alternatively consist of the polypeptide sequence of SEQ ID NO: 901 or SEQ ID NO: 902 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 884; SEQ ID NO: 886; and SEQ ID NO: 888 which correspond to the complementarity-determining regions (CDRs, or hypervariable regions) of the heavy chain sequence of SEQ ID NO: 881 or the variable heavy chain sequence of SEQ ID NO: 882 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 904; SEQ ID NO: 906; and SEQ ID NO: 908 which correspond to the complementarity-determining regions (CDRs, or hypervariable regions) of the light chain sequence of SEQ ID NO: 901 or the variable light chain sequence of SEQ ID NO: 902 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 883; SEQ ID NO: 885; SEQ ID NO: 887; and SEQ ID NO: 889 which correspond to the framework regions (FRs or constant regions) of the heavy chain sequence of SEQ ID NO: 881 or the variable heavy chain sequence of SEQ ID NO: 882 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 903; SEQ ID NO: 905; SEQ ID NO: 907; and SEQ ID NO: 909 which correspond to the framework regions (FRs or constant regions) of the light chain sequence of SEQ ID NO: 901 or the variable light chain sequence of SEQ ID NO: 902 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 882; the variable light chain region of SEQ ID NO: 902; the complementarity-determining regions (SEQ ID NO: 884; SEQ ID NO: 886; and SEQ ID NO: 888) of the variable heavy chain region of SEQ ID NO: 882; and the complementarity-determining regions (SEQ ID NO: 904; SEQ ID NO: 906; and SEQ ID NO: 908) of the variable light chain region of SEQ ID NO: 902 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 882; the variable light chain region of SEQ ID NO: 902; the framework regions (SEQ ID NO: 883; SEQ ID NO: 885; SEQ ID NO: 887; and SEQ ID NO: 889) of the variable heavy chain region of SEQ ID NO: 882; and the framework regions (SEQ ID NO: 903; SEQ ID NO: 905; SEQ ID NO: 907; and SEQ ID NO: 909) of the variable light chain region of SEQ ID NO: 902.

In a particularly preferred embodiment of the invention, the anti-HGF antibody is Ab24, comprising, or alternatively consisting of, SEQ ID NO: 881 and SEQ ID NO: 901, or an antibody or antibody fragment comprising the CDRs of Ab24 and having at least one of the biological activities set forth herein or is an anti-HGF antibody that competes with Ab24 in binding HGF, preferably one containing sequences that are at least 90% or 95% identical to that of Ab24 or an antibody that binds to the same or overlapping epitope(s) on HGF as Ab24.

In a further particularly preferred embodiment of the invention, antibody fragments comprise, or alternatively consist of, Fab (fragment antigen binding) fragments having binding specificity for HGF. With respect to antibody Ab24, the Fab fragment preferably includes the variable heavy chain sequence of SEQ ID NO: 882 and the variable light chain sequence of SEQ ID NO: 902 or sequences that are at least 90% or 95% identical thereto. This embodiment of the invention further includes Fabs containing additions, deletions, and variants of SEQ ID NO: 882 and/or SEQ ID NO: 902 which retain the binding specificity for HGF.

In one embodiment of the invention described herein (infra), Fab fragments may be produced by enzymatic digestion (e.g., papain) of Ab24. In another embodiment of the invention, anti-HGF antibodies such as Ab24 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab24 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab25

In one embodiment, the invention includes antibodies and antibody fragments having binding specificity to HGF that possess a heavy chain sequence comprising the sequence set forth below:

```
                                           (SEQ ID NO: 921)
QSLEESGGRLVTPGTPLTLTCTASGFSLSSYAMGWFRQAPGKGLEWIAYI

FASGSTYYASWAKGRFTISKTSTTVELKITSLTTEDTATYFCARGSGARF

FPNYFAIWGPGTLVTVSSASTKGPSVFPLAPSSKSTSGGTAALGCLVKDY

FPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKD

TLMISRTPEVTCVVVDVSHEDPEVKFNWYVDGVEVHNAKTKPREEQYAST

YRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLD

SDGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                           (SEQ ID NO: 922)
QSLEESGGRLVTPGTPLTLTCTASGFSLSSYAMGWFRQAPGKGLEWIAY

IFASGSTYYASWAKGRFTISKTSTTVELKITSLTTEDTATYFCARGSGA

RFFPNYFAIWGPGTLVTVSS.
```

In another embodiment, the invention includes antibodies and antibody fragments having binding specificity to HGF that possess the same epitopic specificity as Ab25 and which contain a constant heavy chain sequence comprising the sequence set forth below:

```
                                           (SEQ ID NO: 930)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDV

SHEDPEVKFNWYVDGVEVHNAKTKPREEQYASTYRVVSVLTVLHQDWLN

GKEYKCKVSNKALPAPIEKTISKAKGQPREPQVYTLPPSREEMTKNQVS

LTCLVKGFYPSDIAVEWESNGQPENNYKTTPPVLDSDGSFFLYSKLTVD

KSRWQQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                           (SEQ ID NO: 941)
QVLTQTASSVSAAVGGTVTISCQSSQSVTNNNDLAWYQQKPGQPPKLLI

YQASKLASGVPSRFKGSGSGTQFTLTISDLECDDAATYYCQGSYSGGIC

AFGGGTEVVVKRTVAAPSVFIFPPSDEQLKSGTASVVCLLNNFYPREAK

VQWKVDNALQSGNSQESVTEQDSKDSTYSLSSTLTLSKADYEKHKVYAC

EVTHQGLSSPVTKSFNRGEC.
```

In another embodiment, the invention includes antibodies and antibody fragments having binding specificity to HGF that contain a variable light chain sequence comprising the sequence set forth below:

(SEQ ID NO: 942)
QVLTQTASSVSAAVGGTVTISCQSSQSVTNNNDLAWYQQKPGQPPKLLI

YQASKLASGVPSRFKGSGSGTQFTLTISDLECDDAATYYCQGSYSGGIC

AFGGGTEVVVKR.

In another embodiment, the invention includes antibodies and antibody fragments having binding specificity to HGF that bind the same epitope as Ab25 which contain a constant light chain sequence comprising the sequence set forth below:

(SEQ ID NO: 950)
TVAAPSVFIFPPSDEQLKSGTASVVCLLNNFYPREAKVQWKVDNALQSG

NSQESVTEQDSKDSTYSLSSTLTLSKADYEKHKVYACEVTHQGLSSPVT

KSFNRGEC.

In another embodiment, the invention includes antibodies and antibody fragments having binding specificity to HGF that contain one, two, or three of the polypeptide sequences of SEQ ID NO: 924; SEQ ID NO: 926; and SEQ ID NO: 928 which correspond to the complementarity-determining regions (CDRs, or hypervariable regions) of the heavy chain sequence of SEQ ID NO: 921 or which contain the variable heavy chain sequence of SEQ ID NO: 922, and/or which further contain one, two, or three of the polypeptide sequences of SEQ ID NO: 944; SEQ ID NO: 946; and SEQ ID NO: 948 which correspond to the complementarity-determining regions (CDRs, or hypervariable regions) of the light chain sequence of SEQ ID NO: 941 or which contain the variable light chain sequence of SEQ ID NO: 942, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 923; SEQ ID NO: 925; SEQ ID NO: 927; and SEQ ID NO: 929 which correspond to the framework regions (FRs or constant regions) of the heavy chain sequence of SEQ ID NO: 921 or the variable heavy chain sequence of SEQ ID NO: 922, and/or one, two, three, or four of the polypeptide sequences of SEQ ID NO: 943; SEQ ID NO: 945; SEQ ID NO: 947; and SEQ ID NO: 949 which correspond to the framework regions (FRs or constant regions) of the light chain sequence of SEQ ID NO: 941 or the variable light chain sequence of SEQ ID NO: 942, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 921 or SEQ ID NO: 922 or polypeptides that are at least 90% or 95% identical thereto. In another embodiment of the invention, antibody fragments of the invention comprise, or alternatively consist of, the polypeptide sequence of SEQ ID NO: 941 or SEQ ID NO: 942 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 924; SEQ ID NO: 926; and SEQ ID NO: 928 which correspond to the complementarity-determining regions (CDRs, or hypervariable regions) of the heavy chain sequence of SEQ ID NO: 921 or the variable heavy chain sequence of SEQ ID NO: 922 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 944; SEQ ID NO: 946; and SEQ ID NO: 948 which correspond to the complementarity-determining regions (CDRs, or hypervariable regions) of the light chain sequence of SEQ ID NO: 941 or the variable light chain sequence of SEQ ID NO: 942 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 923; SEQ ID NO: 925; SEQ ID NO: 927; and SEQ ID NO: 929 which correspond to the framework regions (FRs or constant regions) of the heavy chain sequence of SEQ ID NO: 921 or the variable heavy chain sequence of SEQ ID NO: 922 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 943; SEQ ID NO: 945; SEQ ID NO: 947; and SEQ ID NO: 949 which correspond to the framework regions (FRs or constant regions) of the light chain sequence of SEQ ID NO: 941 or the variable light chain sequence of SEQ ID NO: 942 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 922; the variable light chain region of SEQ ID NO: 942; the complementarity-determining regions (SEQ ID NO: 924; SEQ ID NO: 926; and SEQ ID NO: 928) of the variable heavy chain region of SEQ ID NO: 922; and the complementarity-determining regions (SEQ ID NO: 944; SEQ ID NO: 946; and SEQ ID NO: 948) of the variable light chain region of SEQ ID NO: 942 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 922; the variable light chain region of SEQ ID NO: 942; the framework regions (SEQ ID NO: 923; SEQ ID NO: 925; SEQ ID NO: 927; and SEQ ID NO: 929) of the variable heavy chain region of SEQ ID NO:

922; and the framework regions (SEQ ID NO: 943; SEQ ID NO: 945; SEQ ID NO: 947; and SEQ ID NO: 949) of the variable light chain region of SEQ ID NO: 942.

In a particularly preferred embodiment of the invention, the anti-HGF antibody is Ab25, comprising, or alternatively consisting of, SEQ ID NO: 921 and SEQ ID NO: 941, or an antibody or antibody fragment comprising the CDRs of Ab25 and having at least one of the biological activities set forth herein or is an anti-HGF antibody that competes with Ab25 in binding HGF, preferably one containing sequences that are at least 90% or 95% identical to that of Ab25 or an antibody that binds to the same or overlapping epitope(s) on HGF as Ab25.

In a further particularly preferred embodiment of the invention, antibody fragments comprise, or alternatively consist of, Fab (fragment antigen binding) fragments having binding specificity for HGF. With respect to antibody Ab25, the Fab fragment preferably includes the variable heavy chain sequence of SEQ ID NO: 922 and the variable light chain sequence of SEQ ID NO: 942 or sequences that are at least 90% or 95% identical thereto. This embodiment of the invention further includes Fabs containing additions, deletions, and variants of SEQ ID NO: 922 and/or SEQ ID NO: 942 which retain the binding specificity for HGF.

In one embodiment of the invention described herein (infra), Fab fragments may be produced by enzymatic digestion (e.g., papain) of Ab25. In another embodiment of the invention, anti-HGF antibodies such as Ab25 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab25 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab26

In one embodiment, the invention includes antibodies and antibody fragments having binding specificity to HGF that possess a heavy chain sequence set forth below:

(SEQ ID NO: 961)
QSVEESGGRLVTPGTPLTLTCTVSGFSLSTYTMNWVRQAPGKGLEYIGF

ISSSSSIDYVSWAKGRFTISKTSTTVDLKITSPTTEDTATYFCARDFYA

DYIGGGYPYIWGPGTLVTVSSASTKGPSVFPLAPSSKSTSGGTAALGCL

VKDYFPEPVTVSWNSGALTSGVHTFPAVLQSSGLYSLSSVVTVPSSSLG

TQTYICNVNHKPSNTKVDKRVEPKSCDKTHTCPPCPAPELLGGPSVFLF

PPKPKDTLMISRTPEVTCVVVDVSHEDPEVKFNWYVDGVEVHNAKTKPR

EEQYASTYRVVSVLTVLHQDWLNGKEYKCKVSNKALPAPIEKTISKAKG

QPREPQVYTLPPSREEMTKNQVSLTCLVKGFYPSDIAVEWESNGQPENN

YKTTPPVLDSDGSFFLYSKLTVDKSRWQQGNVFSCSVMHEALHNHYTQK

SLSLSPGK.

In one embodiment, the invention includes antibodies and antibody fragments having binding specificity to HGF that contain a variable heavy chain sequence comprising the sequence set forth below:

(SEQ ID NO: 962)
QSVEESGGRLVTPGTPLTLTCTVSGFSLSTYTMNWVRQAPGKGLEYIGF

ISSSSSIDYVSWAKGRFTISKTSTTVDLKITSPTTEDTATYFCARDFYA

DYIGGGYPYIWGPGTLVTVSS.

In another embodiment, the invention includes antibodies and antibody fragments having binding specificity to HGF that possess the same epitopic specificity as Ab26 and which contain a constant heavy chain sequence comprising the sequence set forth below:

(SEQ ID NO: 970)
ASTKGPSVFPLAPSSKSTSGGTAALGCLVKDYFPEPVTVSWNSGALTSG

VHTFPAVLQSSGLYSLSSVVTVPSSSLGTQTYICNVNHKPSNTKVDKRV

EPKSCDKTHTCPPCPAPELLGGPSVFLFPPKPKDTLMISRTPEVTCVVV

DVSHEDPEVKFNWYVDGVEVHNAKTKPREEQYASTYRVVSVLTVLHQDW

LNGKEYKCKVSNKALPAPIEKTISKAKGQPREPQVYTLPPSREEMTKNQ

VSLTCLVKGFYPSDIAVEWESNGQPENNYKTTPPVLDSDGSFFLYSKLT

VDKSRWQQGNVFSCSVMHEALHNHYTQKSLSLSPGK.

In another embodiment, the invention includes antibodies and antibody fragments having binding specificity to HGF that contain a light chain sequence comprising the sequence set forth below:

(SEQ ID NO: 981)
ADVVMTQTPASVSEPVGGTVTIKCQASQSISSYLSWYQQKPGQPPKLLIY

GASKLTSGVPSRFKGSGSGTEYTLTISDLECADAATYYCQSNYDIYSYAF

GGGTEVVVKRTVAAPSVFIFPPSDEQLKSGTASVVCLLNNFYPREAKVQW

KVDNALQSGNSQESVTEQDSKDSTYSLSSTLTLSKADYEKHKVYACEVTH

QGLSSPVTKSFNRGEC.

In another embodiment, the invention includes antibodies and antibody fragments having binding specificity to HGF that contain a variable light chain sequence comprising the sequence set forth below:

(SEQ ID NO: 982)
ADVVMTQTPASVSEPVGGTVTIKCQASQSISSYLSWYQQKPGQPPKLLIY

GASKLTSGVPSRFKGSGSGTEYTLTISDLECADAATYYCQSNYDIYSYAF

GGGTEVVVKR.

In another embodiment, the invention includes antibodies and antibody fragments having binding specificity to HGF that bind the same epitope as Ab26 which contain a constant light chain sequence comprising the sequence set forth below:

(SEQ ID NO: 990)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.

In another embodiment, the invention includes antibodies and antibody fragments having binding specificity to HGF that contain one, two, or three of the polypeptide sequences of SEQ ID NO: 964; SEQ ID NO: 966; and SEQ ID NO: 968 which correspond to the complementarity-determining regions (CDRs, or hypervariable regions) of the heavy chain sequence of SEQ ID NO: 961 or which contain the variable heavy chain sequence of SEQ ID NO: 962, and/or which further contain one, two, or three of the polypeptide sequences of SEQ ID NO: 984; SEQ ID NO: 986; and SEQ ID NO: 988 which correspond to the complementarity-determining regions (CDRs, or hypervariable regions) of the light chain sequence of SEQ ID NO: 981 or which contain the variable light chain sequence of SEQ ID NO: 982, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 963; SEQ ID NO: 965; SEQ ID NO: 967; and SEQ ID NO: 969 which correspond to the framework regions (FRs or constant regions) of the heavy chain sequence of SEQ ID NO: 961 or the variable heavy chain sequence of SEQ ID NO: 962, and/or one, two, three, or four of the polypeptide sequences of SEQ ID NO: 983; SEQ ID NO: 985; SEQ ID NO: 987; and SEQ ID NO: 989 which correspond to the framework regions (FRs or constant regions) of the light chain sequence of SEQ ID NO: 981 or the variable light chain sequence of SEQ ID NO: 982, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 961 or SEQ ID NO: 962 or polypeptides that are at least 90% or 95% identical thereto. In another embodiment of the invention, antibody fragments of the invention comprise, or alternatively consist of, the polypeptide sequence of SEQ ID NO: 981 or SEQ ID NO: 982 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 964; SEQ ID NO: 966; and SEQ ID NO: 968 which correspond to the complementarity-determining regions (CDRs, or hypervariable regions) of the heavy chain sequence of SEQ ID NO: 961 or the variable heavy chain sequence of SEQ ID NO: 962 or sequences that are at least 90% or 95% identical thereto.

In a further embodiment of the invention, the antibody or antibody fragment having binding specificity to HGF comprises, or alternatively consists of one, two, or three of the polypeptide sequences of SEQ ID NO: 984; SEQ ID NO: 986; and SEQ ID NO: 988 which correspond to the complementarity-determining regions (CDRs, or hypervariable regions) of the light chain sequence of SEQ ID NO: 981 or the variable light chain sequence of SEQ ID NO: 982 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 963; SEQ ID NO: 965; SEQ ID NO: 967; and SEQ ID NO: 969 which correspond to the framework regions (FRs or constant regions) of the heavy chain sequence of SEQ ID NO: 961 or the variable heavy chain sequence of SEQ ID NO: 962 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 983; SEQ ID NO: 985; SEQ ID NO: 987; and SEQ ID NO: 989 which correspond to the framework regions (FRs or constant regions) of the light chain sequence of SEQ ID NO: 981 or the variable light chain sequence of SEQ ID NO: 982 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 962; the variable light chain region of SEQ ID NO: 982; the complementarity-determining regions (SEQ ID NO: 964; SEQ ID NO: 966; and SEQ ID NO: 968) of the variable heavy chain region of SEQ ID NO: 962; and the complementarity-determining regions (SEQ ID NO: 984; SEQ ID NO: 986; and SEQ ID NO: 988) of the variable light chain region of SEQ ID NO: 982 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 962; the variable light chain region of SEQ ID NO: 982; the framework regions (SEQ ID NO: 963; SEQ ID NO: 965; SEQ ID NO: 967; and SEQ ID NO: 969) of the variable heavy chain region of SEQ ID NO: 962; and the framework regions (SEQ ID NO: 983; SEQ ID NO: 985; SEQ ID NO: 987; and SEQ ID NO: 989) of the variable light chain region of SEQ ID NO: 982.

In a particularly preferred embodiment of the invention, the anti-HGF antibody is Ab26, comprising, or alternatively consisting of, SEQ ID NO: 961 and SEQ ID NO: 981, or an antibody or antibody fragment comprising the CDRs of Ab26 and having at least one of the biological activities set forth herein or is an anti-HGF antibody that competes with Ab26 in binding HGF, preferably one containing sequences that are at least 90% or 95% identical to that of Ab26 or an antibody that binds to the same or overlapping epitope(s) on HGF as Ab26.

In a further particularly preferred embodiment of the invention, antibody fragments comprise, or alternatively consist of, Fab (fragment antigen binding) fragments having binding specificity for HGF. With respect to antibody Ab26, the Fab fragment preferably includes the variable heavy chain sequence of SEQ ID NO: 962 and the variable light chain sequence of SEQ ID NO: 982 or sequences that are at least 90% or 95% identical thereto. This embodiment of the invention further includes Fabs containing additions, deletions, and variants of SEQ ID NO: 962 and/or SEQ ID NO: 982 which retain the binding specificity for HGF.

In one embodiment of the invention described herein (infra), Fab fragments may be produced by enzymatic digestion (e.g., papain) of Ab26. In another embodiment of the invention, anti-HGF antibodies such as Ab26 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab26 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab27

In one embodiment, the invention includes antibodies and antibody fragments having binding specificity to HGF that possess a heavy chain sequence comprising the sequence set forth below:

```
                                          (SEQ ID NO: 1001)
QSLEESGGDLVKPGGTLTLTCTASGFSFSDDHYMCWVRQAPGKGLQWIAC

MYVGSSGATYYASWAKGRFTISKTSSTTVTLQMTSLTAADTATYFCARDD

WTSYYAWGYWALWGPGTLVTVSSASTKGPSVFPLAPSSKSTSGGTAALGC

LVKDYFPEPVTVSWNSGALTSGVHTFPAVLQSSGLYSLSSVVTVPSSSLG

TQTYICNVNHKPSNTKVDKRVEPKSCDKTHTCPPCPAPELLGGPSVFLFP

PKPKDTLMISRTPEVTCVVVDVSHEDPEVKFNWYVDGVEVHNAKTKPREE

QYASTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTT

PPVLDSDGSFFLYSKLTVDKSRWQQGNVFSCSVMHEALHNHYTQKSLSLS

PGK.
```

In one embodiment, the invention includes antibodies and antibody fragments having binding specificity to HGF that contain a variable heavy chain sequence comprising the sequence set forth below:

```
                                          (SEQ ID NO: 1002)
QSLEESGGDLVKPGGTLTLTCTASGFSFSDDHYMCWVRQAPGKGLQWIAC

MYVGSSGATYYASWAKGRFTISKTSSTTVTLQMTSLTAADTATYFCARDD

WTSYYAWGYWALWGPGTLVTVSS.
```

In another embodiment, the invention includes antibodies and antibody fragments having binding specificity to HGF that possess the same epitopic specificity as Ab27 and which contain a constant heavy chain sequence comprising the sequence set forth below:

```
                                          (SEQ ID NO: 1010)
ASTKGPSVFPLAPSSKSTSGGTAALGCLVKDYFPEPVTVSWNSGALTSGV

HTFPAVLQSSGLYSLSSVVTVPSSSLGTQTYICNVNHKPSNTKVDKRVEP

KSCDKTHTCPPCPAPELLGGPSVFLFPPKPKDTLMISRTPEVTCVVVDVS

HEDPEVKFNWYVDGVEVHNAKTKPREEQYASTYRVVSVLTVLHQDWLNGK

EYKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSRW

QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                          (SEQ ID NO: 1021)
ADIVMTQNPASVSEPVGGTVTIKCQASQSVNSWLSWYQQKPGQPPKFLIY

KASTLASGVSSRFKGSGIGTEFTLTISDLECADAATYYCQFSNSGTIYGS

GFGGGTEVVVKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC.
```

In another embodiment, the invention includes antibodies and antibody fragments having binding specificity to HGF that contain a variable light chain sequence comprising the sequence set forth below:

```
                                          (SEQ ID NO: 1022)
ADIVMTQNPASVSEPVGGTVTIKCQASQSVNSWLSWYQQKPGQPPKFLIY

KASTLASGVSSRFKGSGIGTEFTLTISDLECADAATYYCQFSNSGTIYGS

GFGGGTEVVVKR.
```

In another embodiment, the invention includes antibodies and antibody fragments having binding specificity to HGF that bind the same epitope as Ab27 which contain a constant light chain sequence comprising the sequence set forth below:

```
                                          (SEQ ID NO: 1030)
TVAAPSVFIFPPSDEQLKSGTASVVCLLNNFYPREAKVQWKVDNALQSGN

SQESVTEQDSKDSTYSLSSTLTLSKADYEKHKVYACEVTHQGLSSPVTKS

FNRGEC.
```

In another embodiment, the invention includes antibodies and antibody fragments having binding specificity to HGF that contain one, two, or three of the polypeptide sequences of SEQ ID NO: 1004; SEQ ID NO: 1006; and SEQ ID NO: 1008 which correspond to the complementarity-determining regions (CDRs, or hypervariable regions) of the heavy chain sequence of SEQ ID NO: 1001 or which contain the variable heavy chain sequence of SEQ ID NO: 1002, and/or which further contain one, two, or three of the polypeptide sequences of SEQ ID NO: 1024; SEQ ID NO: 1026; and SEQ ID NO: 1028 which correspond to the complementarity-determining regions (CDRs, or hypervariable regions) of the light chain sequence of SEQ ID NO: 1021 or which contain the variable light chain sequence of SEQ ID NO: 1022, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 1003; SEQ ID NO: 1005; SEQ ID NO: 1007; and SEQ ID NO: 1009 which correspond to the framework regions (FRs or constant regions) of the heavy chain sequence of SEQ ID NO: 1001 or the variable heavy chain sequence of SEQ ID NO: 1002, and/or one, two, three, or four of the polypeptide sequences of SEQ ID NO: 1023; SEQ ID NO: 1025; SEQ ID NO: 1027; and SEQ ID NO: 1029 which correspond to the framework regions (FRs or constant regions) of the light chain sequence of SEQ ID NO: 1021 or the variable light chain sequence of SEQ ID NO: 1022, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 1001 or SEQ ID NO: 1002 or polypeptides that are at least 90% or 95% identical thereto. In another embodiment of the invention, antibody fragments of the invention comprise, or alternatively consist of, the polypeptide sequence of SEQ ID NO: 1021 or SEQ ID NO: 1022 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 1004; SEQ ID NO: 1006; and SEQ ID NO: 1008 which correspond to the complementarity-determining regions (CDRs, or hypervariable regions) of the heavy chain sequence of SEQ ID NO: 1001 or the variable heavy chain sequence of SEQ ID NO: 1002 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 1024; SEQ ID NO: 1026; and SEQ ID NO: 1028 which correspond to the complementarity-determining regions (CDRs, or hypervariable regions) of the light chain sequence of SEQ ID NO: 1021 or the variable light chain sequence of SEQ ID NO: 1022 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 1003; SEQ ID NO: 1005; SEQ ID NO: 1007; and SEQ ID NO: 1009 which correspond to the framework regions (FRs or constant regions) of the heavy chain sequence of SEQ ID NO: 1001 or the variable heavy chain sequence of SEQ ID NO: 1002 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 1023; SEQ ID NO: 1025; SEQ ID NO: 1027; and SEQ ID NO: 1029 which correspond to the framework regions (FRs or constant regions) of the light chain sequence of SEQ ID NO: 1021 or the variable light chain sequence of SEQ ID NO: 1022 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 1002; the variable light chain region of SEQ ID NO: 1022; the complementarity-determining regions (SEQ ID NO: 1004; SEQ ID NO: 1006; and SEQ ID NO: 1008) of the variable heavy chain region of SEQ ID NO: 1002; and the complementarity-determining regions (SEQ ID NO: 1024; SEQ ID NO: 1026; and SEQ ID NO: 1028) of the variable light chain region of SEQ ID NO: 1022 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 1002; the variable light chain region of SEQ ID NO: 1022; the framework regions (SEQ ID NO: 1003; SEQ ID NO: 1005; SEQ ID NO: 1007; and SEQ ID NO: 1009) of the variable heavy chain region of SEQ ID NO: 1002; and the framework regions (SEQ ID NO: 1023; SEQ ID NO: 1025; SEQ ID NO: 1027; and SEQ ID NO: 1029) of the variable light chain region of SEQ ID NO: 1022.

In a particularly preferred embodiment of the invention, the anti-HGF antibody is Ab27, comprising, or alternatively consisting of, SEQ ID NO: 1001 and SEQ ID NO: 1021, or an antibody or antibody fragment comprising the CDRs of Ab27 and having at least one of the biological activities set forth herein or is an anti-HGF antibody that competes with Ab27 in binding HGF, preferably one containing sequences that are at least 90% or 95% identical to that of Ab27 or an antibody that binds to the same or overlapping epitope(s) on HGF as Ab27.

In a further particularly preferred embodiment of the invention, antibody fragments comprise, or alternatively consist of, Fab (fragment antigen binding) fragments having binding specificity for HGF. With respect to antibody Ab27, the Fab fragment preferably includes the variable heavy chain sequence of SEQ ID NO: 1002 and the variable light chain sequence of SEQ ID NO: 1022 or sequences that are at least 90% or 95% identical thereto. This embodiment of the invention further includes Fabs containing additions, deletions, and variants of SEQ ID NO: 1002 and/or SEQ ID NO: 1022 which retain the binding specificity for HGF.

In one embodiment of the invention described herein (infra), Fab fragments may be produced by enzymatic digestion (e.g., papain) of Ab27. In another embodiment of the invention, anti-HGF antibodies such as Ab27 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab27 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

Antibody Ab28

In one embodiment, the invention includes antibodies and antibody fragments having binding specificity to HGF that possess a heavy chain sequence comprising the sequence set forth below:

```
                                    (SEQ ID NO: 1041)
EVQLVESGGGLVQPGGSLRLSCAASGFTVSSNAISWVRQAPGKGLEWVGV
IYVIGVTDYASSAQGRFTISRDNSKNTLYLQMNSLRAEDTAVYYCARVYD
SGWNHFNLWGQGTLVTVSSASTKGPSVFPLAPSSKSTSGGTAALGCLVKD
YFPEPVTVSWNSGALTSGVHTFPAVLQSSGLYSLSSVVTVPSSSLGTQTY
ICNVNHKPSNTKVDARVEPKSCDKTHTCPPCPAPELLGGPSVFLFPPKPK
DTLMISRTPEVTCVVVDVSHEDPEVKFNWYVDGVEVHNAKTKPREEQYAS
TYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVL
DSDGSFFLYSKLTVDKSRWQQGNVFSCSVMHEALHNHYTQKSLSLSPGK.
```

In one embodiment, the invention includes antibodies and antibody fragments having binding specificity to HGF that contain a variable heavy chain sequence comprising the sequence set forth below:

```
                                    (SEQ ID NO: 1042)
EVQLVESGGGLVQPGGSLRLSCAASGFTVSSNAISWVRQAPGKGLEWVGV
IYVIGVTDYASSAQGRFTISRDNSKNTLYLQMNSLRAEDTAVYYCARVYD
SGWNHFNLWGQGTLVTVSS.
```

In another embodiment, the invention includes antibodies and antibody fragments having binding specificity to HGF that possess the same epitopic specificity as Ab28 and which contain a constant heavy chain sequence comprising the sequence set forth below:

```
                                    (SEQ ID NO: 1050)
ASTKGPSVFPLAPSSKSTSGGTAALGCLVKDYFPEPVTVSWNSGALTSGV
HTFPAVLQSSGLYSLSSVVTVPSSSLGTQTYICNVNHKPSNTKVDARVEP
KSCDKTHTCPPCPAPELLGGPSVFLFPPKPKDTLMISRTPEVTCVVVDVS
HEDPEVKFNWYVDGVEVHNAKTKPREEQYASTYRVVSVLTVLHQDWLNGK
EYKCKVSNKALPAPIEKTISKAKGQPREPQVYTLPPSREEMTKNQVSLTC
LVKGFYPSDIAVEWESNGQPENNYKTTPPVLDSDGSFFLYSKLTVDKSRW
QQGNVFSCSVMHEALHNHYTQKSLSLSPGK.
```

In another embodiment, the invention includes antibodies and antibody fragments having binding specificity to HGF that contain a light chain sequence comprising the sequence set forth below:

```
                                    (SEQ ID NO: 1061)
DIQMTQSPSTLSASVGDRVTITCQASQSISSWLAWYQQKPGKAPKLLIYE
ASKLASGVPSRFSGSGSGTEFTLTISSLQPDDFATYYCQQAYSVANVDNA
FGGGTKVEIKRTVAAPSVFIFPPSDEQLKSGTASVVCLLNNFYPREAKVQ
WKVDNALQSGNSQESVTEQDSKDSTYSLSSTLTLSKADYEKHKVYACEVT
HQGLSSPVTKSFNRGEC.
```

In another embodiment, the invention includes antibodies and antibody fragments having binding specificity to HGF that contain a variable light chain sequence comprising the sequence set forth below:

```
                                    (SEQ ID NO: 1062)
DIQMTQSPSTLSASVGDRVTITCQASQSISSWLAWYQQKPGKAPKLLIYE
ASKLASGVPSRFSGSGSGTEFTLTISSLQPDDFATYYCQQAYSVANVDNA
FGGGTKVEIKR.
```

In another embodiment, the invention includes antibodies and antibody fragments having binding specificity to HGF that bind the same epitope as Ab28 which contain a constant light chain sequence comprising the sequence set forth below:

```
                                    (SEQ ID NO: 1070)
TVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKS
FNRGEC.
```

In another embodiment, the invention includes antibodies and antibody fragments having binding specificity to HGF that contain one, two, or three of the polypeptide sequences of SEQ ID NO: 1044; SEQ ID NO: 1046; and SEQ ID NO: 1048 which correspond to the complementarity-determining regions (CDRs, or hypervariable regions) of the heavy chain sequence of SEQ ID NO: 1041 or which contain the variable heavy chain sequence of SEQ ID NO: 1042, and/or which further contain one, two, or three of the polypeptide sequences of SEQ ID NO: 1064; SEQ ID NO: 1066; and SEQ ID NO: 1068 which correspond to the complementarity-determining regions (CDRs, or hypervariable regions) of the light chain sequence of SEQ ID NO: 1061 or which contain the variable light chain sequence of SEQ ID NO: 1062, or antibodies or fragments containing combinations of sequences which are at least 80%, 85%, 90%, 95%, 96%, 97%, 98% or 99% identical thereto. In another embodiment of the invention, the antibodies of the invention or fragments thereof comprise, or alternatively consist of, combinations of one or more of the exemplified variable heavy chain and variable light chain sequences, or the heavy chain and light chain sequences set forth above, or sequences that are at least 90% or 95% identical thereto.

The invention further contemplates anti-HGF antibodies and antibody fragments comprising one, two, three, or four of the polypeptide sequences of SEQ ID NO: 1043; SEQ ID NO: 1045; SEQ ID NO: 1047; and SEQ ID NO: 1049 which correspond to the framework regions (FRs or constant regions) of the heavy chain sequence of SEQ ID NO: 1041 or the variable heavy chain sequence of SEQ ID NO: 1042, and/or one, two, three, or four of the polypeptide sequences of SEQ ID NO: 1063; SEQ ID NO: 1065; SEQ ID NO: 1067; and SEQ ID NO: 1069 which correspond to the framework regions (FRs or constant regions) of the light chain sequence of SEQ ID NO: 1061 or the variable light chain sequence of SEQ ID NO: 1062, or combinations of these polypeptide sequences or sequences which are at least 80%, 90% or 95% identical therewith.

In another embodiment of the invention, the antibodies and antibody fragments of the invention or fragments thereof comprise, or alternatively consist of, combinations of one or more of the FRs, CDRs, the variable heavy chain and variable light chain sequences, and the heavy chain and light chain sequences set forth above, including all of them or sequences which are at least 90% or 95% identical thereto.

In another embodiment of the invention, the anti-HGF antibody fragments of the invention comprise, or alternatively consist of, the polypeptide sequence of SEQ ID NO: 1041 or SEQ ID NO: 1042 or polypeptides that are at least 90% or 95% identical thereto. In another embodiment of the invention, antibody fragments of the invention comprise, or alternatively consist of, the polypeptide sequence of SEQ ID NO: 1061 or SEQ ID NO: 1062 or polypeptides that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 1044; SEQ ID NO: 1046; and SEQ ID NO: 1048 which correspond to the complementarity-determining regions (CDRs, or hypervariable regions) of the heavy chain sequence of SEQ ID NO: 1041 or the variable heavy chain sequence of SEQ ID NO: 1042 or sequences that are at least 90% or 95% identical thereto.

In a further embodiment of the invention, the antibody or antibody fragment having binding specificity to HGF comprises, or alternatively consists of, one, two, or three of the polypeptide sequences of SEQ ID NO: 1064; SEQ ID NO: 1066; and SEQ ID NO: 1068 which correspond to the complementarity-determining regions (CDRs, or hypervariable regions) of the light chain sequence of SEQ ID NO: 1061 or the variable light chain sequence of SEQ ID NO: 1062 or sequences that are at least 90% or 95% identical thereto.

In a further embodiment of the invention, the antibody or antibody fragment having binding specificity to HGF comprises, or alternatively consists of, one, two, three, or four of the polypeptide sequences of SEQ ID NO: 1043; SEQ ID NO: 1045; SEQ ID NO: 1047; and SEQ ID NO: 1049 which correspond to the framework regions (FRs or constant regions) of the heavy chain sequence of SEQ ID NO: 1041 or the variable heavy chain sequence of SEQ ID NO: 1042 or sequences that are at least 90% or 95% identical thereto.

In a further embodiment of the invention, the subject antibody or antibody fragment having binding specificity to HGF comprises, or alternatively consists of, one, two, three, or four of the polypeptide sequences of SEQ ID NO: 1063; SEQ ID NO: 1065; SEQ ID NO: 1067; and SEQ ID NO: 1069 which correspond to the framework regions (FRs or constant regions) of the light chain sequence of SEQ ID NO: 1061 or the variable light chain sequence of SEQ ID NO: 1062 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 1042; the variable light chain region of SEQ ID NO: 1062; the complementarity-determining regions (SEQ ID NO: 1044; SEQ ID NO: 1046; and SEQ ID NO: 1048) of the variable heavy chain region of SEQ ID NO: 1042; and the complementarity-determining regions (SEQ ID NO: 1064; SEQ ID NO: 1066; and SEQ ID NO: 1068) of the variable light chain region of SEQ ID NO: 1062 or sequences that are at least 90% or 95% identical thereto.

The invention also contemplates antibody fragments that include one or more of the antibody fragments described herein. In one embodiment of the invention, fragments of the antibodies having binding specificity to HGF comprise, or alternatively consist of, one, two, three or more, including all of the following antibody fragments: the variable heavy chain region of SEQ ID NO: 1042; the variable light chain region of SEQ ID NO: 1062; the framework regions (SEQ ID NO: 1043; SEQ ID NO: 1045; SEQ ID NO: 1047; and SEQ ID NO: 1049) of the variable heavy chain region of SEQ ID NO: 1042; and the framework regions (SEQ ID NO: 1063; SEQ ID NO: 1065; SEQ ID NO: 1067; and SEQ ID NO: 1069) of the variable light chain region of SEQ ID NO: 1062.

In a particularly preferred embodiment of the invention, the anti-HGF antibody is Ab28, comprising, or alternatively consisting of, SEQ ID NO: 1041 and SEQ ID NO: 1061, or an antibody or antibody fragment comprising the CDRs of Ab28 and having at least one of the biological activities set forth herein or is an anti-HGF antibody that competes with Ab28 in binding HGF, preferably one containing sequences that are at least 90% or 95% identical to that of Ab28 or an antibody that binds to the same or overlapping epitope(s) on HGF as Ab28.

In a further particularly preferred embodiment of the invention, antibody fragments comprise, or alternatively consist of, Fab (fragment antigen binding) fragments having binding specificity for HGF. With respect to antibody Ab28, the Fab fragment preferably includes the variable heavy chain sequence of SEQ ID NO: 1042 and the variable light chain sequence of SEQ ID NO: 1062 or sequences that are at least 90% or 95% identical thereto. This embodiment of the invention further includes Fabs containing additions, deletions, and variants of SEQ ID NO: 1042 and/or SEQ ID NO: 1062 which retain the binding specificity for HGF.

In one embodiment of the invention described herein (infra), Fab fragments may be produced by enzymatic digestion (e.g., papain) of Ab28. In another embodiment of the invention, anti-HGF antibodies such as Ab28 or Fab fragments thereof may be produced via expression in mammalian cells such as CHO, NSO or HEK 293 cells, fungal, insect, or microbial systems such as yeast cells (for example haploid or diploid yeast such as haploid or diploid *Pichia*) and other yeast strains. Suitable *Pichia* species include, but are not limited to, *Pichia pastoris*.

In an additional embodiment, the invention is further directed to polynucleotides encoding antibody polypeptides having binding specificity to HGF, including the heavy and/or light chains of Ab28 as well as fragments, variants, combinations of one or more of the FRs, CDRs, the variable heavy chain and variable light chain sequences, and the heavy chain and light chain sequences set forth above, including all of them or sequences which are at least 90% or 95% identical thereto.

In another embodiment, the invention contemplates an isolated anti-HGF antibody comprising any of the afore-identified $V_H$ polypeptide sequences; and further comprising any of the afore-identified $V_L$ polypeptide sequence, wherein one or more of the framework residues (FR residues) in said $V_H$ or $V_L$ polypeptide has been substituted with another amino acid residue resulting in an anti-HGF antibody that specifically binds HGF. The invention contemplates humanized and chimeric forms of these antibodies. The chimeric antibodies may include an Fc derived from IgG1, IgG2, IgG3, IgG4, IgG5, IgG6, IgG7, IgG8, IgG9, IgG10, IgG11, IgG12, IgG13, IgG14, IgG15, IgG16, IgG17, IgG18 or IgG19, IgG20, IgG21 and other antibody constant regions, which optionally may be mutagenized or fragmented.

In one embodiment of the invention, the antibodies or $V_H$ or $V_L$ polypeptides originate or are selected from one or more rabbit B cell populations prior to initiation of the humanization process referenced herein.

In another embodiment of the invention, the anti-HGF antibodies and fragments thereof which have binding specificity for human HGF and allelic variants of human HGF may also bind to non-human HGF polypeptides including primate homologs of human HGF such as HGF expressed in chimpanzee, monkey, ape, gibbon, gorilla, lemur and other primates, and potentially to non-primate HGF polypeptides such as rabbit, canine, rodent, feline, and other HGF species homologs.

In another embodiment of the invention, the anti-HGF antibodies and fragments thereof do not have binding specificity for HGFR (c-met). In a further embodiment of the invention, the anti-HGF antibodies and fragments thereof inhibit the association of HGF with HGFR. In another embodiment of the invention, the anti-HGF antibodies and fragments thereof inhibit the association of HGF with HGFR and/or multimers thereof and/or antagonizes the biological effects thereof.

In addition, the subject anti-HGF antibodies and fragments thereof may be modified post-translationally to add effector moieties such as chemical linkers, detectable moieties such as for example fluorescent dyes, enzymes, substrates, bioluminescent materials, radioactive materials, and chemiluminescent moieties, or functional moieties such as for example streptavidin, avidin, biotin, a cytotoxin, a cytotoxic agent, and radioactive materials.

Regarding detectable moieties, further exemplary enzymes include, but are not limited to, horseradish peroxidase, acetylcholinesterase, alkaline phosphatase, beta-galactosidase and luciferase. Further exemplary fluorescent materials include, but are not limited to, rhodamine, fluorescein, fluorescein isothiocyanate, umbelliferone, dichlorotriazinylamine, phycoerythrin and dansyl chloride. Further exemplary chemiluminescent moieties include, but are not limited to, luminol. Further exemplary bioluminescent materials include, but are not limited to, luciferin and aequorin. Further exemplary radioactive materials include, but are not limited to, Iodine 125 ($^{125}$I), Carbon 14 ($^{14}$C), Sulfur 35 ($^{35}$S), Tritium ($^{3}$H) and Phosphorus 32 ($^{32}$P).

In another embodiment the subject anti-HGF antibodies and fragments may be attached or administered in combination therapies with one or more other functional moieties, exemplary cytotoxic agents include, but are not limited to, methotrexate, aminopterin, 6-mercaptopurine, 6-thioguanine, cytarabine, 5-fluorouracil decarbazine; alkylating agents such as mechlorethamine, thioepa chlorambucil, melphalan, carmustine (BSNU), mitomycin C, lomustine (CCNU), 1-methylnitrosourea, cyclothosphamide, mechlorethamine, busulfan, dibromomannitol, streptozotocin, mitomycin C, cis-dichlorodiamine platinum (II) (DDP) cisplatin and carboplatin (paraplatin); anthracyclines include daunorubicin (formerly daunomycin), doxorubicin (adriamycin), detorubicin, caminomycin, idarubicin, epirubicin, mitoxantrone and bisantrene; antibiotics include dactinomycin (actinomycin D), bleomycin, calicheamicin, mithramycin, and anthramycin (AMC); and antimytotic agents such as the vinca alkaloids, vincristine and vinblastine. Other cytotoxic agents include paclitaxel (taxol), ricin, *pseudomonas* exotoxin, gemcitabine, cytochalasin B, gramicidin D, ethidium bromide, emetine, etoposide, tenoposide, colchicin, dihydroxy anthracin dione, 1-dehydrotestosterone, glucocorticoids, procaine, tetracaine, lidocaine, propranolol, puromycin, procarbazine, hydroxyurea, asparaginase, corticosteroids, mytotane (O,P'-(DDD)), interferons, and mixtures of these cytotoxic agents.

Further cytotoxic agents include, but are not limited to, chemotherapeutic agents such as carboplatin, cisplatin, paclitaxel, gemcitabine, calicheamicin, doxorubicin, 5-fluorouracil, mitomycin C, actinomycin D, cyclophosphamide, vincristine and bleomycin. Toxic proteins from plants and bacteria such as ricin, diphtheria toxin and *Pseudomonas* toxin may be conjugated to the humanized or chimeric antibodies, or binding fragments thereof, to generate cell-type-specific-killing reagents (Youle, et al., Proc. Nat'l Acad. Sci. USA 77:5483 (1980); Gilliland, et al., Proc. Nat'l Acad. Sci. USA 77:4539 (1980); Krolick, et al., Proc. Nat'l Acad. Sci. USA 77:5419 (1980)).

Other cytotoxic agents which may be used in combination with the subject anti-HGF antibodies and fragments include cytotoxic ribonucleases as described by Goldenberg in U.S. Pat. No. 6,653,104. Embodiments of the invention also relate to radioimmunoconjugates where a radionuclide that emits alpha or beta particles is stably coupled to the antibody, or binding fragments thereof, with or without the use of a complex-forming agent. Such radionuclides include beta-emitters such as Phosphorus-32 ($^{32}$P), Scandium-47 ($^{47}$Sc), Copper-67 ($^{67}$Cu), Gallium-67 ($^{67}$Ga), Yttrium-88 ($^{88}$Y), Yttrium-90 ($^{90}$Y), Iodine-125 ($^{125}$I), Iodine-131 ($^{131}$I), Samarium-153 ($^{153}$Sm), Lutetium-177 ($^{177}$Lu), Rhenium-186 ($^{186}$Re) or Rhenium-188 ($^{188}$Re), and alpha-emitters such as Astatine-211 ($^{211}$At), Lead-212 ($^{212}$Pb), Bismuth-212 ($^{212}$Bi) or -213 ($^{213}$Bi) or Actinium-225 ($^{225}$Ac). The term "cytotoxic agent" as used herein broadly includes any substance that inhibits or prevents the function of cells and/or causes destruction of cells and "chemotherapeutic agent" useful in the treatment of cancer The term is intended to include radioactive isotopes, chemotherapeutic agents e.g. methotrexate, adriamicin, vinca alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below. A tumoricidal agent causes destruction of tumor cells. A "chemotherapeutic agent" is a chemical compound useful in the treatment of cancer. Examples of chemotherapeutic agents include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethiylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfomithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; CPT-11; topoisomerase inhibitor RFS 2000; difluoromethylornithine (DMFO); retinoids such as retinoic acid; capecitabine; and pharmaceutically acceptable salts, acids or derivatives of any of the above. Also included in the definition of "chemotherapeutic agent" above are anti-hormonal agents that act to regulate or inhibit hormone action on tumors such as anti-estrogens and selective estrogen receptor modulators (SERMs), including, for example, tamoxifen (including NOLVADEX® tamoxifen), raloxifene, droloxifene, 4-hydroxytamoxifen, trioxifene, keoxifene, LY117018, onapristone, and FARESTON. toremifene; aromatase inhibitors that inhibit the enzyme aromatase, which regulates estrogen production in the adrenal glands, such as, for example, 4(5)-imidazoles, aminoglutethimide, MEGASE® megestrol acetate, AROMASIN® exemestane, formestanie, fadrozole, RIVISOR® vorozole, FEMARA® letrozole, and ARIMIDEX® anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those which inhibit expression of genes in signaling pathways implicated in abherant cell proliferation, such as, for example, PKC-alpha, Ralf and H-Ras; ribozymes such as a VEGF expression inhibitor (e.g., ANGIOZYME® ribozyme) and a HER2 expression inhibitor; vaccines such as gene therapy vaccines, for example, ALLOVECTIN® vaccine, LEUVECTIN™ vaccine, and VAXID® vaccine; PROLEUKIN® rIL-2; LURTOTECAN® topoisomerase 1 inhibitor; ABARELIX® rmRH; and pharmaceutically acceptable salts, acids or derivatives of any of the above. Preferred examples of cytotoxic agents used in association with the subject anti-HGF antibodies and fragments are Erlotinib, Gemcitabine, Premetrexed, Docetaxel, Folfox Chemotherapy Regime Combinations, Paclitaxel And Bevacizumab.

Other cytotoxic agents include cytotoxic ribonucleases as described by Goldenberg in U.S. Pat. No. 6,653,104. Embodiments of the invention also relate to radioimmunoconjugates where a radionuclide that emits alpha or beta particles is stably coupled to the antibody, or binding fragments thereof, with or without the use of a complex-forming agent. Such radionuclides include beta-emitters such as Phosphorus-32 ($^{32}$P), Scandium-47 ($^{47}$Sc), Copper-67 ($^{67}$Cu), Gallium-67 ($^{67}$Ga), Yttrium-88 ($^{88}$Y), Yttrium-90 ($^{90}$Y), Iodine-125 ($^{125}$I), Iodine-131 ($^{131}$I), Samarium-153 ($^{153}$Sm), Lutetium-177 ($^{177}$Lu), Rhenium-186 ($^{186}$Re) or Rhenium-188 ($^{188}$Re), and alpha-emitters such as Astatine-211 ($^{211}$At) Lead-212 ($^{212}$Pb) Bismuth-212 ($^{212}$Bi) or -213 ($^{213}$Bi) or Actinium-225 ($^{225}$Ac).

Methods are known in the art for conjugating an antibody or binding fragment thereof to a detectable moiety and the like, such as for example those methods described by Hunter et al, Nature 144:945 (1962); David et al, Biochemistry 13:1014 (1974); Pain et al, J. Immunol. Meth. 40:219 (1981); and Nygren, J., Histochem. and Cytochem. 30:407 (1982).

Embodiments described herein further include variants and equivalents that are substantially homologous to the antibodies, antibody fragments, diabodies, SMIPs, camelbodies, nanobodies, IgNAR, polypeptides, variable regions and CDRs set forth herein. These may contain, e.g., conservative substitution mutations, (i.e., the substitution of one or more amino acids by similar amino acids). For example, conservative substitution refers to the substitution of an amino acid with another within the same general class, e.g., one acidic amino acid with another acidic amino acid, one basic amino acid with another basic amino acid, or one neutral amino acid by another neutral amino acid. What is intended by a conservative amino acid substitution is well known in the art.

In another embodiment, the invention contemplates polypeptide sequences having at least 90% or greater sequence homology to any one or more of the polypeptide sequences of antibody fragments, variable regions and CDRs set forth herein. More preferably, the invention contemplates polypeptide sequences having at least 95% or greater sequence homology, even more preferably at least 98% or greater sequence homology, and still more preferably at least 99% or greater sequence homology to any one or more of the polypeptide sequences of antibody fragments, variable regions and CDRs set forth herein. Methods for determining homology between nucleic acid and amino acid sequences are well known to those of ordinary skill in the art.

In another embodiment, the invention further contemplates the above-recited polypeptide homologs of the antibody fragments, variable regions and CDRs set forth herein further having anti-HGF activity. Non-limiting examples of anti-HGF activity are set forth herein.

In another embodiment, the invention further contemplates the generation and use of anti-idiotypic antibodies that bind any of the foregoing sequences. In an exemplary embodiment, such an anti-idiotypic antibody could be administered to a subject who has received an anti-HGF antibody to modulate, reduce, or neutralize, the effect of the anti-HGF antibody. Such anti-idiotypic antibodies could also be useful for treatment of an autoimmune disease characterized by the presence of anti-HGF antibodies. A further exemplary use of such anti-idiotypic antibodies is for detection of the anti-HGF antibodies of the present invention, for example to monitor the levels of the anti-HGF antibodies present in a subject's blood or other bodily fluids.

The present invention also contemplates anti-HGF antibodies comprising any of the polypeptide or polynucleotide sequences described herein substituted for any of the other polynucleotide sequences described herein. For example, without limitation thereto, the present invention contemplates antibodies comprising the combination of any of the variable light chain and variable heavy chain sequences described herein, and further contemplates antibodies resulting from substitution of any of the CDR sequences described herein for any of the other CDR sequences described herein.

Additional Exemplary Embodiments of the Invention

In another embodiment, the invention contemplates one or more anti-human HGF antibodies or antibody fragments which specifically bind to the same linear or conformational epitope(s) and/or competes for binding to the same linear or conformational epitope(s) on an intact human HGF polypeptide or fragment thereof as an anti-human HGF antibody selected from the group consisting of Ab1, Ab2, Ab3, Ab4, Ab5, Ab6, Ab7, Ab8, Ab9, Ab10, Ab11, Ab12, Ab13 Ab14, Ab15, Ab16, Ab17, Ab18, Ab19, Ab20, Ab21, Ab23, Ab24, Ab25, Ab26, Ab27 and Ab28. In a preferred embodiment, the anti-human HGF antibody or fragment specifically binds to the same linear or conformational epitope(s) and/or competes for binding to the same linear or conformational epitope(s) on an intact human HGF polypeptide or a fragment thereof as Ab1, Ab2, Ab7, Ab8, Ab9, Ab10, Ab12, Ab14, Ab19, Ab21, Ab23, Ab24, Ab25, and Ab28.

In another embodiment of the invention, the anti-human HGF antibody which specifically binds to the same linear or conformational epitopes on an intact HGF polypeptide or fragment thereof that is (are) specifically bound by one of Ab1, Ab2, Ab3, Ab4, Ab5, Ab6, Ab7, Ab8, Ab9, Ab10, Ab11, Ab12, Ab13 Ab14, Ab15, Ab16, Ab17, Ab18, Ab19, Ab20, Ab21, Ab23, Ab24, Ab25, Ab26, Ab27 and Ab28 binds to HGF epitope(s) ascertained by epitopic mapping using overlapping linear peptide fragments which span the full length of the native human HGF polypeptide.

The invention is also directed to an anti-HGF antibody that binds with the same HGF epitope and/or competes with an anti-HGF antibody for binding to HGF as an antibody or antibody fragment disclosed herein, including but not limited to an anti-HGF antibody selected from of Ab1, Ab2, Ab3, Ab4, Ab5, Ab6, Ab7, Ab8, Ab9, Ab10, Ab11, Ab12, Ab13 Ab14, Ab15, Ab16, Ab17, Ab18, Ab19, Ab20, Ab21, Ab23, Ab24, Ab25, Ab26, Ab27 and Ab28 or preferably one of Ab1, Ab2, Ab7, Ab8, Ab9, Ab10, Ab12, Ab14, Ab19, Ab21, Ab23, Ab24, Ab25, or Ab28. In another embodiment, the invention is also directed to an isolated anti-HGF antibody or antibody fragment comprising one or more of the CDRs contained in the $V_H$ polypeptide of an anti-HGF antibody selected from of Ab1, Ab2, Ab3, Ab4, Ab5, Ab6, Ab7, Ab8, Ab9, Ab10, Ab11, Ab12, Ab13 Ab14, Ab15, Ab16, Ab17, Ab18, Ab19, Ab20, Ab21, Ab23, Ab24, Ab25, Ab26, Ab27 and Ab28 or preferably one of as Ab1, Ab2, Ab7, Ab8, Ab9, Ab10, Ab12, Ab14, Ab19, Ab21, Ab23, Ab24, Ab25, and Ab28.

In one embodiment of the invention, the anti-human HGF antibody comprises at least 2 complementarity determining regions (CDRs) in each the variable light and the variable heavy regions which are identical to those contained in an anti-human HGF antibody selected from the group consisting of an anti-HGF antibody selected from of Ab1, Ab2, Ab3, Ab4, Ab5, Ab6, Ab7, Ab8, Ab9, Ab10, Ab11, Ab12, Ab13 Ab14, Ab15, Ab16, Ab17, Ab18, Ab19, Ab20, Ab21, Ab23, Ab24, Ab25, Ab26, Ab27 and Ab28 or preferably one of Ab1, Ab2, Ab7, Ab8, Ab9, Ab10, Ab12, Ab14, Ab19, Ab21, Ab23, Ab24, Ab25, and Ab28.

In a preferred embodiment, the anti-human HGF antibody discussed above comprises at least 2 complementarity determining regions (CDRs) in each the variable light and the variable heavy regions which are identical to those contained in an anti-HGF antibody selected from of Ab1, Ab2, Ab7, Ab8, Ab9, Ab10, Ab12, Ab14, Ab19, Ab21, Ab23, Ab24, Ab25, and Ab28. In another embodiment, all of the CDRs of the anti-human HGF antibody discussed above are identical to the CDRs contained in an anti-human HGF antibody selected from the group consisting of an anti-HGF antibody selected from of Ab1, Ab2, Ab3, Ab4, Ab5, Ab6, Ab7, Ab8, Ab9, Ab10, Ab11, Ab12, Ab13 Ab14, Ab15, Ab16, Ab17, Ab18, Ab19, Ab20, Ab21, Ab23, Ab24, Ab25, Ab26, Ab27 and Ab28 or preferably one of as Ab1, Ab2, Ab7, Ab8, Ab9, Ab10, Ab12, Ab14, Ab19, Ab21, Ab23, Ab24, Ab25, and Ab28. In a preferred embodiment of the invention, all of the CDRs of the anti-human HGF antibody discussed above are identical to the CDRs contained in of Ab1, Ab2, Ab7, Ab8, Ab9, Ab10, Ab12, Ab14, Ab19, Ab21, Ab23, Ab24, Ab25, or Ab28 or preferably one of Ab1, Ab2, Ab7, Ab8, Ab9, Ab10, Ab12, Ab14, Ab19, Ab21, Ab23, Ab24, Ab25, and Ab28.

The invention further contemplates that the one or more anti-human HGF antibodies discussed above are aglycosylated; that contain an Fc region that has been modified to alter effector function, half-life, proteolysis, and/or glycosylation; are human, humanized, single chain or chimeric; and are a humanized antibody derived from a rabbit (parent) anti-human HGF antibody.

The invention further contemplates one or more anti-human HGF antibodies wherein the framework regions (FRs) in the variable light region and the variable heavy regions of said antibody respectively are human FRs which are unmodified or which have been modified by the substitution of at most 2 or 3 human FR residues in the variable light or heavy chain region with the corresponding FR residues of the parent rabbit antibody, and wherein said human FRs have been derived from human variable heavy and light chain antibody sequences which have been selected from a library of human germline antibody sequences based on their high level of homology to the corresponding rabbit variable heavy or light chain regions relative to other human germline antibody sequences contained in the library.

In one embodiment of the invention, the anti-human HGF antibody or fragment specifically binds to HGF expressing human cells and/or to circulating soluble HGF molecules in vivo, including HGF expressed on or by human cells in a patient with a disease associated with cells that express HGF.

In another embodiment, the disease is selected from cancers, including ovarian cancer, breast cancer, lung cancer (small cell or non-small cell), colon cancer, prostate cancer, pancreatic cancer, renal cancer, gastric cancer, liver cancer, head-and-neck tumors, melanoma, sarcomas, and brain tumors (e.g., glioblastomas), of children or adults; leukemias; lymphomas; macular degeneration; Alzheimer's disease; and malarial infection. In a preferred embodiment, the disease is selected from a cancer or macular degeneration. In a particularly preferred embodiment, the disease is a cancer such as ovarian cancer, breast cancer, lung cancer (small cell or non-small cell), colon cancer, prostate cancer, pancreatic cancer, renal cancer, gastric cancer, liver cancer, head-and-neck tumors, melanoma, sarcomas, and brain tumors (e.g., glioblastomas), of children or adults; leukemias; lymphomas or another cancer.

The invention further contemplates anti-human HGF antibodies or fragments directly or indirectly attached to a detectable label or therapeutic agent.

The invention also contemplates one or more nucleic acid sequences which result in the expression of an anti-human HGF antibody or antibody fragment as set forth above, including those comprising, or alternatively consisting of, yeast or human preferred codons. The invention also contemplates vectors (including plasmids or recombinant viral vectors) comprising said nucleic acid sequence(s). The invention also contemplates host cells or recombinant host cells expressing at least one of the antibodies set forth above, including a mammalian, yeast, bacterial, and insect cells. In a preferred embodiment, the host cell is a yeast cell. In a further preferred embodiment, the yeast cell is a diploidal yeast cell. In a more preferred embodiment, the yeast cell is a *Pichia* yeast.

The invention also contemplates a method of treatment comprising administering to a patient with a disease or condition associated with HGF expressing cells a therapeutically effective amount of at least one anti-human HGF antibody or fragment described herein. The invention also contemplates that the treatment method may involve the administration of two or more anti-HGF antibodies or fragments thereof and disclosed herein. If more than one antibody is administered to the patient, the multiple antibodies may be administered simultaneously or concurrently, or may be staggered in their administration. The diseases that may be treated are presented in the non-limiting list set forth above and elsewhere herein. In a preferred embodiment, the disease is selected from a cancer or macular degeneration. In a particularly preferred embodiment, the disease is a cancer. In another embodiment the treatment further includes the administration of another therapeutic agent or regimen selected from chemotherapy, radiotherapy, cytokine administration or gene therapy.

In a non-limiting embodiment of the invention, the other therapeutic agent or regimen includes Taxol (paclitaxel) or its derivatives, platinum compounds such as carboplatin or cisplatin, anthrocyclines such as doxorubicin, alkylating agents such as cyclophosphamide, anti-metabolites such as 5-fluorouracil, or etoposide. In addition, other therapeutic agents may be used in combination with the subject anti-HGF antibodies and fragments, or other agents or methods used to treat cancer or other conditions wherein the use of an HGF antagonist is therapeutically beneficial.

For example, the other agent may be radiation, chemotherapy, another anti-angiogenic agent, an anti-proliferative agent. Other agents which may be used in association with the subject anti-HGF antibodies and fragments are disclosed infra. Preferred examples include EGFR inhibitors such as a nucleoside analogue; or an inhibitor of platelet-derived growth factor receptor (PDGFR), vascular endothelial growth factor receptor (VEGFR), c-KIT kinase, or FMS-like tyrosine kinase 3 (FLT3). Such EGFR antagonist may function by binding to EGFR and competitively blocking binding of EGF or activation by EGF, for example the anti-EGFR mAbs cetuximab and panitumumab, or by inhibiting the tyrosine kinase activity of EGFR, for example erlotinib and gefitinib. More generally, downstream signaling pathways that may be inhibited by the second agent in the invention include the RAS-RAF-MEK-APK pathway and the P13K-AKT pathway. Many other signaling pathways and their inhibitors are well known to those skilled in the art of cellular biology. The nucleoside analogues include gemcitabine, methotrexate, 5-fluorouracil, cytosine arabinoside, behenoyl cytosine arabinoside, tegafur, UFT, and the like. The inhibitors of PDGFR, VEGFR, c-KIT kinase or FLT3 include sunitinib, sorafenib, motesanib, and the like.

Also, the subject anti-HGF antibodies and fragments may be used in combination with hedgehog inhibitors such as an inhibitor of the Hedgehog (HH) signaling pathway (particularly the HH pathway in humans), e.g., an agent that inhibits the ability of an HH protein to stimulate a cell via this pathway, also called an HH pathway inhibitor or simply HH inhibitor. Such an agent may bind to the one or more of the HH ligands—Sonic Hedgehog (SHH), Indian Hedgehog (IHH) and Desert Hedgehog (DHH)—or to their Patched 1 (PTCH1) or Patched 2 (PTCH2) receptors or to a downstream mediator such as Smoothened (SMOH) or SuFu or Iguana (also known as DZIP1), or to one or more of the transcription factors GLI1, GLI2, and GLI3 activated by the pathway. All of these hedgehog pathway proteins are well known human proteins for which sequences are available from UniProtKB/Swiss-Prot and similar databases. Insofar as a protein has more than one known form in a species due to natural allelic variation between individuals, an inhibitor can bind to and inhibit any, or all, of such known allelic forms, and preferably binds to and inhibits the wildtype, most common or first published allelic faun. Exemplary sequences for human SHH, IHH and DHH are assigned UniProtKB-Swiss-Prot accession numbers Q15465, Q14623, O43323 and respectively. Exemplary sequences for other human hedgehog pathway proteins are: PTCH1 (Q13635), PTCH2(Q9Y6C5), SMOH (Q99835), DZIP1 (Q86YF9), SuFu (Q9UMX1), Gli1 (P08151), Gli2 (P10070), Gli3 (P10071). The agent may be a protein such as a mAb, preferably a chimeric, humanized or human mAb, which binds to one or more of the HH proteins or to PTCH1 (or PTCH2), or may be a small molecule (i.e., a compound having relatively low molecular weight, most often less than 500 or 600 or 1000 kDa). Exemplary small molecule second agents are cyclopamine, KAAD-cyclopamine (3-Keto-N-(aminoethyl-aminocaproyl-dihydrocinnamoyl)cyclopamine), SANT1-4 (Chen et al., Proc. Natl. Acad. Sci. USA 2002, 99: 14071-14076), CUR61414 (Williams et al., PNAS 2003 100: 8 4616-4621) and HhAntag-691 (Romer et al., Cancer Cell. 2004; 6:229-240); JK814 Lee, ChemBioChem 2007, 8: 1916-1919). Other examples of HH antagonists are described by WO/2004/020599 and Katoh, Cancer Biol Ther. 2005 4:1050-4, and U.S. Pat. No. 7,300,929.

Also, the subject anti-HGF antibodies and fragments may be used in combination with an agonist of PTEN, preferably human PTEN. As used herein, an "agonist of PTEN" or "PTEN agonist" means an agent that stimulates the expression of PTEN in a cell, or stimulates the activity of PTEN, or which can provide one or more of the functions of PTEN, e.g., in regulating the PI3K/Akt/mTOR pathway. For example, PTEN is able to indirectly reduce the activity of mTOR (mammalian target of rapamycin) by downregulating the activity of Akt An inhibitor of mTOR directly reproduces this particular role of PTEN—reduction of mTOR activity—so such an inhibitor is considered herein to be a PTEN agonist. This type of PTEN agonist will replace some but not necessarily all the functions of the tumor suppressor PTEN in a cancer cell with mutated or deleted PTEN, and may therefore cause the cell to revert to a more normal, less malignant phenotype. Preferred PTEN agonists/mTOR inhibitors for use in the invention include rapamycin (Rapamune™, sirolimus, ATC code L04AA10 commercially available from Wyeth) and its chemical analogues such as CCI-779 (temsirolimus, Anatomical Therapeutic Chemical (ATC) code L01XE09, commercially available from Wyeth), RAD-001 (everolimus, ATC code L04AA18. commercially available from Novartis) and AP-2357 (Granville et al., op. cit.). Many PTEN agonists are small molecules (i.e., a compound having relatively low molecular weight, most often less than 500 or 600 kDa, or about 1000 kDa in the case of a macrolide such as rapamycin). Other agonists include mAbs, and zinc finger proteins or nucleic acids encoding the same, engineered to bind to and activate transcription of PTEN (see, e.g., WO 00/00388). Other PTEN agonists are described in US20070280918. Whereas proteins are typically administered parenterally, e.g. intravenously, small molecules may be administered parenterally or orally. PTEN and mTOR (also known as FRAP1) are well known human proteins for which sequences are available from UniProtKB/Swiss-Prot and similar databases. Insofar as a protein has more than one known form in a species due to natural allelic variation between individuals, an inhibitor can bind to and inhibit any, or all, of such known allelic forms, and preferably binds to and inhibits the wildtype, most common or first published allelic form. Exemplary sequences for human PTEN and mTOR (FRAP1) are assigned UniProtKB/Swiss-Prot accession numbers P60484 and P42345. This is intended to be exemplary and not exhaustive of potential combination therapies involving the subject anti-HGF antibodies and fragments and another active agent.

The invention further contemplates a method of in vivo imaging which detects the presence of cells which express HGF comprising administering a diagnostically effective amount of at least one anti-human HGF antibody according to the invention, preferably of Ab1, Ab2, Ab7, Ab8, Ab9, Ab10, Ab12, Ab14, Ab19, Ab21, Ab23, Ab24, Ab25, or Ab28. In one embodiment, said administration further includes the administration of a radionuclide or fluorophore that facilitates detection of the antibody at HGF expressing disease sites. In another embodiment of the invention, the method of in vivo imaging is used to detect HGF expressing tumors or metastases, or tumors or metastases expressing HGF-R capable of binding to HGF. In a further embodiment, the results of said in vivo imaging method are used to facilitate the design of an appropriate therapeutic regimen, including therapeutic regimens including radiotherapy, chemotherapy or a combination thereof.

Polynucleotides Encoding Anti-HGF Antibody Polypeptides

Antibody Ab1

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 1: cagtcggtggaggagtccggggggtcgcctggtcacgcctgggacaccctgacactcacctgcacagtactggattctccctca gtgcctatgc- aatgagctgggtccgccaggctccagagaagggggctggagtggatcgcagtca-tttatgttattggtgccactgact acgcgagctgggcgaaaggccgattcaccat-ctccagaacctcgaccacggtggatctgagaatccccagtccgacaaccgag-gacacggccacctatttctgtgccagagtttatgattctgtctggaatcactttaact-tgtggggcccgggcaccctggtcaccgtctcgagcgcctccaccaagggc-ccatcggtcttccccctggcaccctcctccaagagcacctctgggggcacagcg-gccctgggctgcctggtcaaggactacttccccgaaccggtgacggtgtcg-tggaactcaggcgccctgaccagcggcgtgcacaccttcccggctgtcctaca-gtcctcaggactctactccctcagcagcgtggtgaccgtgccctccagcagct-tgggcacccagacctacatctgcaacgtgaatcacaagcccagcaacaccaag--gtggacaagagagttgagcccaaatcttgtgacaaaactcacacatgcccaccgtg cccagcacctgaactcctggggggaccgtcagtcttcctcttcccccaaaaccc-aaggacaccctcatgatctcccggacccctaggtcacatgcgtggtggtg-gacgtgagccacgaagaccctgaggtcaagttcaactggtacgtggac-ggcgtggaggtgcataatgccaagacaaagccgcgggaggagcagtac-gccagcacgtaccgtgtggtcagcgtcctcaccgtcctgcaccaggactgg ctgaatggcaaggagtacaagtgcaaggtctccaacaaagccctcccagcc-cccatcgagaaaaccatctccaaagccaaagggcagccccgagaaccacag-gtgtacaccctgcccccatcccgggaggagatgaccaagaaccaggtcagcct-gacctgcctggtcaaaggcttctatcccagcgacatcgccgtggagtgg-gagagcaatgggcagccggagaacaactacaagaccacgcctcccgtgctg-gactccgacggctccttcttcctctacagcaagctcaccgtggacaagagcag-gtggcagcagggggaacgtcttacatgctccgtgatgcatgaggctctgcacaac--cactacacgcagaagagcctctccctgtctccgggtaaa (SEQ ID NO: 11).

In another embodiment of the invention, the polynucleotides of the invention comprise, or alternatively consist of, the following polynucleotide sequence encoding the variable heavy chain polypeptide sequence of SEQ ID NO: 2: cagtcggtggaggagtccggggggtcgcctggtcacgcctgggacaccctgacactcacctgcacagtctctggattctccctcagtgcctatgcaatgagctgggtc- cgccaggctccagagaagggctggagtggatcgcagtcatttatgttattggt- gccactgactacgcgagagggcgaaaggccgattcaccatctccagaacctc- gaccacggtggatctgagaatccccagtccgacaaccgag gacacggcc- acctatttctgtgccagagtttatgattctgtctggaatcactttaacttgtgggg- cccgggcaccctggtcaccgtctc gagc (SEQ ID NO: 12).

In another embodiment of the invention, polynucleotides of the invention comprise, or alternatively consist of, the following polynucleotide sequence encoding the constant heavy chain polypeptide sequence of SEQ ID NO: 10: gcctccaccaagggcccatcggtcttccccctggcaccctcctccaagagcacc- tctgggggcacagcggccctgggctgcctg gtcaaggactacttcc- ccgaac- cggtgacggtgtcgtggaactcaggcgccctgaccagcggcgtgc- acaccttc- ccggctgtcc tacagtcctcaggactctactccctcagcagcgtggtgaccg- tgccctccagcagcttgggcacccagacctacatctgcaacgtg aatca- caagcccagcaacaccaaggtggacaagagagttgagcccaaatcttgtgaca- aaactcacacatgccaccgtgccca gcacctgaactcctgggggac- cgtcagtcttcctcttcccccaaaacccaaggacaccctcatgatctcccgga- cccctgaggt cacatgcgtggtggtggacgtgagccacgaagaccctgaggt- caagttcaactggtacgtggacggcgtggaggtgcataatgc caagac- aaagccgcgggaggagcagtacgccagcacgtaccgtgtggtcagcgtcct- caccgtcctgcaccaggactggctga atggcaaggagtacaagt- gcaaggtctccaacaaagcccctcccagccccccatcgagaaaaccatctccaa- agccaaagggcag ccccgagaaccacaggtgtacaccctgccc- ccatc- ccgggaggagatgaccaagaaccaggtcagcctgacctgcctggtcaa agg- cttctatcccagcgacatcgccgtggagtgggagagcaatgggcagccggag- aacaactacaagaccacgcctcccgtgct ggactccgacggctccttcttcc- tctacagcaagctcaccgtggacaagagcaggtggcagcaggggaacgtcttct- catgctccg tgatgcatgaggctctgcacaaccactacacgcagaagagcctctc- cctgtctccgggtaaa (SEQ ID NO: 20).

In another embodiment of the invention, polynucleotides of the invention comprise, or alternatively consist of, the following polynucleotide sequence encoding the light chain polypeptide sequence of SEQ ID NO: 21: gcctatgatatgac- ccagactccagcctctgtggaggtagctgtgggggggcaca- gtcaccatcaagt- gccaggccagtcagagca ttagcagttggttagcctggtatcagcagaaaccag- ggcagcctcccaagacctgatctaccaggcatctaaactggcatctggggtcc- catcgcggttcaaaggcagtggatctgggacagagttcactctcaccatcagc- ggcgtggagtgtgccgatgctgccactta ctattgtcaacaggcttatagtgt- tagtaatgttgataatgctttcggcggagggaccgaggtggtggtcaaacgtacg- gtggctgca ccatctgtatcatcttcccgccatctgatgagca- gttgaaatctg- gaactgcctctgagtgtgcctgctgaataacttctatcccagag ag- gccaaag- tacagtggaaggtggataacgccctccaatcgggtaactcccagg- agagtgtcacagagcaggacagcaaggac agcacctacagcctcagcag- caccctgacgctgagcaaagcagactacgagaaacacaaagtctacgcctgc- gaagtcacccat cagggcctgagctcgcccgtcacaaagagcttcaaca- ggggagagtgt (SEQ ID NO: 31).

In another embodiment of the invention, polynucleotides of the invention comprise, or alternatively consist of, the following polynucleotide sequence encoding the variable light chain polypeptide sequence of SEQ ID NO: 22: gcctat- gatatgacccagactccagcctctgtggaggtagctgtgggggggcacagtcac- catcaagtgccaggccagtcagagca ttagcagttggttagcctggtatcagca- gaaaccagggcagcctcccaagctcctgatctaccaggcatctaaactggcat- ctggg gtcccatcgcggttcaaaggcagtggatctgggacagagttcactct- caccatcagcggcgtggagtgtgccgatgctgccactta ctattgtca- acag- gcttatagtgttagtaatgttgataatgctttcggcggagggaccgaggtggtggt- caaacgt (SEQ ID NO: 32).

In another embodiment of the invention, polynucleotides of the invention comprise, or alternatively consist of, the following polynucleotide sequence encoding the constant light chain polypeptide sequence of SEQ ID NO: 30: acg- gtggctgcaccatctgtcttcatcttcccgccatctgatgagcagttgaaatct- ggaactgcctctgttgtgtgcctgctgaataac ttctatcccagagagg- ccaaag- tacagtggaaggtggataacgccctccaatcgggtaactcccaggagagtgt- cacagagcag gacagcaaggacagcacctacagcctcagcagcaccctga- cgctgagcaaagcagactacgagaaacacaaagtctacgcctg cgaagtcac- ccatcagggcctgagctcgcccgtcacaaagagcttcaacaggggagagtgt (SEQ ID NO: 40).

In a further embodiment of the invention, polynucleotides encoding antibody fragments having binding specificity to HGF comprise, or alternatively consist of, one or more of the polynucleotide sequences of SEQ ID NO: 14; SEQ ID NO: 16; and SEQ ID NO: 18, which correspond to polynucleotides encoding the complementarity-determining regions (CDRs, or hypervariable regions) of the heavy chain sequence of SEQ ID NO: 1 or the variable heavy chain sequence of SEQ ID NO: 2, and/or one or more of the polynucleotide sequences of SEQ ID NO: 34; SEQ ID NO: 36; and SEQ ID NO: 38, which correspond to the complementarity-determining regions (CDRs, or hypervariable regions) of the light chain sequence of SEQ ID NO: 21 or the variable light chain sequence of SEQ ID NO: 22, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 13; SEQ ID NO: 15; SEQ ID NO: 17; and SEQ ID NO: 19, which correspond to polynucleotides encoding the framework regions (FRs or constant regions) of the heavy chain sequence of SEQ ID NO: 1 or the variable heavy chain sequence of SEQ ID NO: 2, and/or one or more of the polynucleotide sequences of SEQ ID NO: 33; SEQ ID NO: 35; SEQ ID NO: 37; and SEQ ID NO: 39, which correspond to the framework regions (FRs or constant regions) of the light chain sequence of SEQ ID NO: 21 or the variable light chain sequence of SEQ ID NO: 22, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 11 encoding the heavy chain sequence of SEQ ID NO: 1; the polynucleotide SEQ ID NO: 12 encoding the variable heavy chain sequence of SEQ ID NO: 2; the polynucleotide SEQ ID NO: 31 encoding the light chain sequence of SEQ ID NO: 21; the polynucleotide SEQ ID NO: 32 encoding the variable light chain sequence of SEQ ID NO: 22; polynucleotides encoding the complementarity-determining regions (SEQ ID NO: 14; SEQ ID NO: 16; and SEQ ID NO: 18) of the heavy chain sequence of SEQ ID NO: 1 or the variable heavy chain sequence of SEQ ID NO: 2; polynucleotides encoding the complementarity-determining regions (SEQ ID NO: 34; SEQ ID NO: 36; and SEQ ID NO: 38) of the light chain sequence of SEQ ID NO: 21 or the variable light chain sequence of SEQ ID NO: 22; polynucleotides encoding the framework regions (SEQ ID NO: 13; SEQ ID NO: 15; SEQ ID NO: 17; and SEQ ID NO: 19) of the heavy chain sequence of SEQ ID NO: 1 or the variable heavy chain sequence of SEQ ID NO: 2; and polynucleotides encoding the framework regions (SEQ ID NO: 33; SEQ ID NO: 35; SEQ ID NO: 37; and SEQ ID NO: 39) of the light chain sequence of SEQ ID NO: 21 or the variable light chain sequence of SEQ ID NO: 22.

In a preferred embodiment of the invention, polynucleotides of the invention comprise, or alternatively consist of, polynucleotides encoding Fab (fragment antigen binding) fragments having binding specificity for HGF. With respect to antibody Ab1, the polynucleotides encoding the full length Ab1 antibody comprise, or alternatively consist of, the polynucleotide SEQ ID NO: 11 encoding the heavy chain sequence of SEQ ID NO: 1 and the polynucleotide SEQ ID NO: 31 encoding the light chain sequence of SEQ ID NO: 21.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab1 following expression of the full-length polynucleotides in a suitable host. In another embodiment of the invention, anti-HGF antibodies such as Ab1 or Fab fragments thereof may be produced via expression of Ab1 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab2

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 41: gaggtgcagctggtggagtctggggaggcaggtccagc-ctgggggtccctgagactctcctgtgcagcctctggattcaccg tcagtgc-ctatgcaatgagctgggtccgtccgtcaggctccagggaaggggctggagtgggtc-gcagtcatctatgttattggtgccactg actacgcgagcagtgcgataggc-gattcaccatctccagagacaattccaagaacaccctgtatcttcaaatgaaca-gcctgaga gctgaggacactgctgtgtattactgtgctagagtttatgattct-gtctggaatcacttcaacttgtggggccaagggaccctcgtcac cgtct-cgagcgcctccaccaagggcccatcggtcttcccctggcaccctcctccaag-agcacctctggggggcacagcggccct gggctgcctggtcaaggactacttc-cccgaaccggtgacggtgtcgtggaactcaggcgccctgaccagcggcgtg-cacacctt cccggctgtcctacagtcctcaggactctactccctcagcagcg-tggtgaccgtgccctccagcagcttgggcacccagacctaca tctgcaacgt-gaatcacaagcccagcaacaccaaggtggacaagagagttgagcccaaatctt-gtgacaaaactcacacatgcce accgtgcccagcacctgaactcctgggggga-ccgtcagtcttcctcttccccccaaaacccaaggacaccctcatgatctcccgga cccctgaggtcacatgcgtggtggtggacgtgagccacgaagaccctgaggtc-aagttcaactggtacgtggacggcgtggagg tgcataatgccaagacaaagc-cgcgggaggagcagtacgccagcacgtaccgtgtggtcagcgtcctcac-cgtc-ctgcaccagg actgctgaatggcaaggagtacaagtgcaaggtctccaac-aaagccctcccagcccccatcgagaaaaccatctccaaagcca aagggcag-ccccgagaaccacaggtgtacaccctgccccccatcccgggaggagatgaccaa-gaaccaggtcagcctgacctg cctggtcaaaggcttctatcccagcgaca-tcgccgtggagtgggagagcaatgggcagccggagaacaactacaagac-cacgc ctcccgtgctggactccgacggctccttcttcctctacagcaagctcac-- cgtggacaagagcaggtggcagcaggggaacgtcttc tcatgctccgtgatgca-tgaggctctgcacaaccactacacgcagaagagcctctccctgtctccgggtaaa (SEQ ID NO: 51).

In another embodiment of the invention, the polynucleotides of the invention comprise, or alternatively consist of, the following polynucleotide sequence encoding the variable heavy chain polypeptide sequence of SEQ ID NO: 42: gaggtgcagctggtggagtctggggaggcttggtccagcctgggggtccct-gagactctcctgtgcagcctctggattcaccg tcagtgcctatgcaatgag-ctgggtccgtcaggctccagggaaggggctggagtgggtcgcagtcatctatg-ttattggtgccactg actacgcgagcagtgcgaaaggccgattcaccatctc-cagagacaattccaagaacaccctgtatcttcaaatgaacagcctgaga gct-gaggacactgctgtgtattactgtgctagagtttatgattctgtctggaatcacttca-acttgtggggccaagggaccctcgtcac cgtctcgagc (SEQ ID NO: 52).

In another embodiment of the invention, polynucleotides of the invention comprise, or alternatively consist of, the following polynucleotide sequence encoding the constant heavy chain polypeptide sequence of SEQ ID NO: 50: gcctccaccaagggcccatcggtcttcccctggcaccctcctccaagagcac-ctctggggggcacagcggccctgggctgcctg gtcaaggactactt-ccccgaaccggtgacggtgtcgtggaactcaggcgccctgaccagcggcgtg-cacaccttcccggctgtcc tacagtcctcaggactctactccctcagcagcgtg-gtgaccgtgccctccagcagcttgggcacccagacctacatctgcaacgtg aat-cacaagcccagcaacaccaaggtggacaagagagttgagcccaaatctt-gtgacaaaactcacacatgcccaccgtgccca gcacctgaactcct-ggggggaccgtcagtcttcctcttccccccaaaacccaaggacaccctcatgatct-cccggacccctgaggt cacatgcgtggtggtggacgtgagccacgaaccc-tgaggtcaagttcaactggtacgtggacggcgtggaggtgcataatgc caaga-caaagccgcgggaggagcagtacgccagcacgtaccgtgtggtcagcgtcctc-accgtcctgcaccaggactggctga atggcaaggagtacaagtgcaaggtctc-caacaaagccctcccagcccccatcgagaaaaccatctccaaagc-caaagggcag ccccgagaaccacaggtgtacaccctgcccccatccc-gggaggagatgaccaagaaccaggtcagcctgacctgcctggtcaa aggct-tctatcccagcgacatcgccgtggagtgggagagcaatgggcagccgga-gaacaactacaagaccacgcctcccgtgct ggactccgacggctccttcttc-ctctacagcaagctcaccgtggacaagagcaggtggcagcaggggaacgtct-tctcatgctccg tgatgcatgaggctctgcacaaccactacacgcagaagagc-ctctccctgtctccgggtaaa (SEQ ID NO: 60).

In another embodiment of the invention, polynucleotides of the invention comprise, or alternatively consist of, the following polynucleotide sequence encoding the light chain polypeptide sequence of SEQ ID NO: 61: gacatccagatgac-ccagtctccttccaccctgtctgcatctgtaggagacagag- tcaccatcacttgc-caggccagtcagagcatt agcagaggttagccttggtatcagcagaaaccagga-aaagcccctaagacctgatctatcaggcatctaaactggcatctggagtc cc-atcaaggttcagcggcagtggatctggaacagaattcactctcaccatcagcagc-ctgcagcctgatgattttgcaacttattact gccaacaggcttatagtgttagtaa-tgttgataatgctttcggcggaggaaccaaggtggaaatcaaacgtacggtagcg-gccccat ctgtcttcatcacccgccatctgatgagcagttgaaatctggaactgc-ctctgttgtgtgcctgctgaataacttctatcccagagagg ccaaagtacagtg-gaaggtggataacgccctccaatcgggtaactcccaggagagtgtcacagag-caggacagcaaggacagc acctacagcctcagcagcaccctgacgctgag-caaagcagactacgagaaacacaaagtctacgcctgcgaagtcacccatcag ggcctgagctcgcccgtcacaaagagcttcaacaggggagagtgt (SEQ ID NO: 71).

In another embodiment of the invention, polynucleotides of the invention comprise, or alternatively consist of, the following polynucleotide sequence encoding the variable light chain polypeptide sequence of SEQ ID NO: 62: gacatc-cagatgacccagtaccaccaccctgtctgcatctgtaggagacagagt- caccat-cacttgccaggccagtcagagcatt agcagttggttagcctggtatcagcagaa-accaggaaaagcccctaagctcctgatctatcaggcatctaaactggcatctg-gagtc ccatcaaggttcagcggcagtggatctggaacagaattcactctcac-catcagcagcctgcagcctgatgattttgcaacttattact gccaacaggcttata-gtgttagtaatgagataatgattcggcggaggaaccaaggtggaaatcaaacgt (SEQ ID NO: 72).

In another embodiment of the invention, polynucleotides of the invention comprise, or alternatively consist of, the following polynucleotide sequence encoding the constant light chain polypeptide sequence of SEQ ID NO: 70: acggtagcggccccatctgtcttcatcttcccgccatctgatgagcagttgaaatctggaactgcctctgttgtgtgcctgctgaataa cttctatcccagagaggccaaag-tacagtggaaggtggataacgccctccaatcgggtaactcccaggagagtgtcacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 80).

In a further embodiment of the invention, polynucleotides encoding antibody fragments having binding specificity to HGF comprise, or alternatively consist of, one or more of the polynucleotide sequences of SEQ ID NO: 54; SEQ ID NO: 56; and SEQ ID NO: 58, which correspond to polynucleotides encoding the complementarity-determining regions (CDRs, or hypervariable regions) of the heavy chain sequence of SEQ ID NO: 41 or the variable heavy chain sequence of SEQ ID NO: 42, and/or one or more of the polynucleotide sequences of SEQ ID NO: 74; SEQ ID NO: 76; and SEQ ID NO: 78, which correspond to the complementarity-determining regions (CDRs, or hypervariable regions) of the light chain sequence of SEQ ID NO: 61 or the variable light chain sequence of SEQ ID NO: 62, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 53; SEQ ID NO: 55; SEQ ID NO: 57; and SEQ ID NO: 59, which correspond to polynucleotides encoding the framework regions (FRs or constant regions) of the heavy chain sequence of SEQ ID NO: 41 or the variable heavy chain sequence of SEQ ID NO: 42, and/or one or more of the polynucleotide sequences of SEQ ID NO: 73; SEQ ID NO: 75; SEQ ID NO: 77; and SEQ ID NO: 79, which correspond to the framework regions (FRs or constant regions) of the light chain sequence of SEQ ID NO: 61 or the variable light chain sequence of SEQ ID NO: 62, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 51 encoding the heavy chain sequence of SEQ ID NO: 41; the polynucleotide SEQ ID NO: 52 encoding the variable heavy chain sequence of SEQ ID NO: 42; the polynucleotide SEQ ID NO: 71 encoding the light chain sequence of SEQ ID NO: 61; the polynucleotide SEQ ID NO: 72 encoding the variable light chain sequence of SEQ ID NO: 62; polynucleotides encoding the complementarity-determining regions (SEQ ID NO: 54; SEQ ID NO: 56; and SEQ ID NO: 58) of the heavy chain sequence of SEQ ID NO: 41 or the variable heavy chain sequence of SEQ ID NO: 42; polynucleotides encoding the complementarity-determining regions (SEQ ID NO: 74; SEQ ID NO: 76; and SEQ ID NO: 78) of the light chain sequence of SEQ ID NO: 61 or the variable light chain sequence of SEQ ID NO: 62; polynucleotides encoding the framework regions (SEQ ID NO: 53; SEQ ID NO: 55; SEQ ID NO: 57; and SEQ ID NO: 59) of the heavy chain sequence of SEQ ID NO: 41 or the variable heavy chain sequence of SEQ ID NO: 42; and polynucleotides encoding the framework regions (SEQ ID NO: 73; SEQ ID NO: 75; SEQ ID NO: 77; and SEQ ID NO: 79) of the light chain sequence of SEQ ID NO: 61 or the variable light chain sequence of SEQ ID NO: 62.

In a preferred embodiment of the invention, polynucleotides of the invention comprise, or alternatively consist of, polynucleotides encoding Fab (fragment antigen binding) fragments having binding specificity for HGF. With respect to antibody Ab2, the polynucleotides encoding the full length Ab2 antibody comprise, or alternatively consist of, the polynucleotide SEQ ID NO: 51 encoding the heavy chain sequence of SEQ ID NO: 41 and the polynucleotide SEQ ID NO: 71 encoding the light chain sequence of SEQ ID NO: 61.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab2 following expression of the full-length polynucleotides in a suitable host. In another embodiment of the invention, anti-HGF antibodies such as Ab2 or Fab fragments thereof may be produced via expression of Ab2 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab3

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 81: cagtcggtggaggagtccggggggtcgcctggtcacgcctgggacacccttgacactcacctgcacagtactggactcaccatta gtagctactacatgagctgggtccgccaggctccagggaaggggctggaatggatcggaaccattaatcctggtgctaacacata cttcgcgagctgggcaaaaggccgattcacatctccagaacctcgaccacggtggatctgaaaatcaccagtccgacaaccgag gacacggccacatatttctgtgccagagaggggggatagtaatgactgggggtgtcttgacttgtgggggccagggcaccctggtcac cgtctcgagcgcctccaccaagggcccatcggtcttcccctggcacccctcctccaagagcacctctgggggcacagcggccct gggctgcctggtcaaggactacttccccgaaccggtgacggtgtcgtggaactcaggcgccctgaccagcggcgtgcacaccttc ccggctgtcctacagtcctcaggactctactccctcagcagcgtggtgaccgtgccaccagcagcttgggcacccagacctaca tctgcaacgtgaatcacaagcccagcaacaccaaggtggacaagagagttgagcccaaatcttgtgacaaaactcacacatgccc accgtgcccagcacctgaactcctgggggaccgtcagtcttcctcttccccccaaaacccaaggacaccctcatgatctcccgga ccctgaggtcacatgcgtggtggtggacgtgagccacgaagaccctgaggtcaagttcaactggtacgtggacggcgtggagg tgcataatgccaagacaaagccgcgggaggagcagtacgccagcacgtaccgtgtggtcagcgtcctcaccgtc-
ctgcaccagg actggctgaatggcaaggagtacaagtgcaaggtctc-
caacaaagccctcccagccccatcgagaaaaccatctccaaagcca-
aagggcagccccgagaaccacaggtgtacaccctgcccccatcccgggag-
gagatgaccaagaaccaggtcagcctgacctg cctggtcaaaggcttctatc-
ccagcgacatcgccgtggagtgggagagcaatgggcagccggagaaacta-
caagaccacgc ctcccgtgctggactccgacggctccttcttcctctacag-
caagctcaccgtggacaagagcaggtggcagcaggggaacgtcttc
tcatgctccgtgatgcatgaggctctgcacaaccactacacgcagaagagc-
ctctccctgtctccgggtaaa (SEQ ID NO: 91).

In another embodiment of the invention, the polynucle-
otides of the invention comprise, or alternatively consist of, the following polynucleotide sequence encoding the variable heavy chain polypeptide sequence of SEQ ID NO: 82:
cagtcggtggaggagtccgggggtcgcctggtcacgcctgggacaccttga-
cactcacctgcacagtctctggactcaccatta gtagctac- tacat-
gagctgggtccgccaggctccagggaaggggctggaatggatcggaaccat-
taatcctggtgctaacacata cttcgcgagctgggcaaaaggccgattcac-
catctccagaacctcgaccacggtggatctgaaaatcaccagtccgacaaccgag
gacacggccacatatttctgtgccagagagggggatagtaatgactgggtgtc-
tttgacttgtggggccagggcaccctggtcac cgtctcgagc (SEQ ID NO: 92).

In another embodiment of the invention, polynucleotides of the invention comprise, or alternatively consist of, the following polynucleotide sequence encoding the constant heavy chain polypeptide sequence of SEQ ID NO: 90:
gcctccaccaagggcccatcggtcttccccctggcaccctcctccaagagcac-
ctctgggggcacagcggccctgggctgcctg gtcaaggactac- ttc-
cccgaaccggtgacggtgtcgtggaactcaggcgccctgaccagcggcgt-
gcacaccttcccggctgtcc tacagtcctcaggactctactccctcagca-
gcgtggtgaccgtgccaccagcagcttgggcacccagacctacatctgcaacgtg
aatcacaagcccagcaacaccaaggtggacaagagagttgagcccaaatcttg-
tgacaaaactcacacatgcccaccgtgccca gcacctgaactcc-
tggggggaccgtcagtcttcctcttccccccaaaacccaaggacaccctcatgat-
ctcccggacccctgaggt cacatgcgtggtggtggacgtgagccacgaagac-
cctgaggtcaagttcaactggtacgtggacggcgtggaggtgcataatgc
caagacaaagccgcgggaggagcagtacgccagcacgtaccgtgtggtca-
gcgtcctcaccgtcctgcaccaggactggctga atggcaa- ggagtacaagtg-
caaggtctccaacaaagccctcccagccccatcgagaaaaccatctc-
caaagccaaagggcag ccccgagaaccacaggtgtacaccctgcccccatc-
ccgggaggagatgaccaagaaccaggtcagcctgacctgcctggtcaa
aggcttctatcccagcgacatcgccgtggagtgggagagcaatgggcagccg-
gagaacaactacaagaccacgcctcccgtgct ggactccgacg- gctcatcttc-
ctctacagcaagctcaccgtggacaagagcaggtggcagcaggggaacgtct-
tctcatgctccg tgatgcatgaggctctgcacaaccactacacgcagaagagc-
ctctccctgtctccgggtaaa (SEQ ID NO: 100).

In another embodiment of the invention, polynucleotides of the invention comprise, or alternatively consist of, the following polynucleotide sequence encoding the light chain polypeptide sequence of SEQ ID NO: 101: gcctatg- atat-
gacccagactccagcctctgtagagatagagtgggaggcacagtcaccatcag-
gtgccaggccagtgaggaca ttgaaagctatttagcctggtatcag agaaac-
cagggcagcctcccaaactcctgatctacagggcatccgatctggcatctgggg
tacatcgcggttcaaaggcagtggatctgggacagactacactctcaccatcagc-
ggcgtggagtgtgacgatgctgccacttact actgtcaacagggttatactatc-
gataatgttgataatactacggcggagggaccgaggtggtggtcaaacgtacg-
gtagcggccc catctgtcttcatcttcccgccatctgatgagcagttgaaatctg-
gaactgcctctgttgtgtgcctgctgaataacttctatcccagaga ggccaaa-
gtacagtggaaggtggataacgccaccaatcgggtaactcccaggagagtgtc-
acagagcaggacagcaaggaca gcacctacagcctcagcagcaccct-
gacgctgagcaaagcagactacgagaaacacaaagtctacgcctgcgaagt-
cacccatcagggcctgagctcgcccgtcacaaagagcttcaacaggggagagtgt
(SEQ ID NO: 111).

In another embodiment of the invention, polynucleotides of the invention comprise, or alternatively consist of, the following polynucleotide sequence encoding the variable light chain polypeptide sequence of SEQ ID NO: 102:
gcctatgatatgacccagactccagcctctgtagagatagctgtgggaggcaca-
gtcaccatcaggtgccaggccagtgaggaca ttgaaagctatttagcct-
ggtatcagcagaaaccagggcagcctcccaaactcctgatctacagggcatccg-
atctggcatctgggg tctcatcgccggttcaaaggcagtggatctgggacag-
actacactctcaccatcagcggcgtggagtgtgacgatgctgccacttact actgt-
caacagggttatactatcgataatgttgataatactttcggcggagggaccgag-
gtggtggtcaaacgt (SEQ ID NO: 112).

In another embodiment of the invention, polynucleotides of the invention comprise, or alternatively consist of, the following polynucleotide sequence encoding the constant light chain polypeptide sequence of SEQ ID NO: 110:
acggtagcggcccccatctgtcttcatcttcccgccatctgatgagcagttgaaatct-
ggaactgcctctgttgtgtgcctgctgaataa cttctatcccagaga- gaggccaaag-
tacagtggaaggtggataacgccctccaatcgggtaactcccaggagagtgt-
cacagagca ggacagcaaggacagcacctacagcctcagcagcaccctga-
cgctgagcaaagcagactacgagaaacacaaagtctacgcct gcgaagtcac-
ccatcagggcctgagctcgcccgtcacaaagagcttcaacaggggagagtgt
(SEQ ID NO: 120).

In a further embodiment of the invention, polynucleotides encoding antibody fragments having binding specificity to HGF comprise, or alternatively consist of, one or more of the polynucleotide sequences of SEQ ID NO: 94; SEQ ID NO: 96; and SEQ ID NO: 98, which correspond to polynucleotides encoding the complementarity-determining regions (CDRs, or hypervariable regions) of the heavy chain sequence of SEQ ID NO: 81 or the variable heavy chain sequence of SEQ ID NO: 82, and/or one or more of the polynucleotide sequences of SEQ ID NO: 114; SEQ ID NO: 116; and SEQ ID NO: 118, which correspond to the complementarity-determining regions (CDRs, or hypervariable regions) of the light chain sequence of SEQ ID NO: 101 or the variable light chain sequence of SEQ ID NO: 102, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 93; SEQ ID NO: 95; SEQ ID NO: 97; and SEQ ID NO: 99, which correspond to polynucleotides encoding the framework regions (FRs or constant regions) of the heavy chain sequence of SEQ ID NO: 81 or the variable heavy chain sequence of SEQ ID NO: 82, and/or one or more of the polynucleotide sequences of SEQ ID NO: 113; SEQ ID NO: 115; SEQ ID NO: 117; and SEQ ID NO: 119, which correspond to the framework regions (FRs or constant regions) of the light chain sequence of SEQ ID NO: 101 or the variable light chain sequence of SEQ ID NO: 102, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 91 encoding the heavy chain sequence of SEQ ID NO: 81; the polynucleotide SEQ ID NO: 92 encoding the variable heavy chain sequence of SEQ ID NO: 82; the polynucleotide SEQ ID NO: 111 encoding the light chain sequence of SEQ ID NO: 101; the polynucleotide SEQ ID NO: 112 encoding the variable light chain sequence of SEQ ID NO: 102; polynucleotides encoding the complementarity-determining regions (SEQ ID NO: 94; SEQ ID NO: 96; and SEQ ID NO: 98) of the heavy chain sequence of SEQ ID NO: 81 or the variable heavy chain sequence of SEQ ID NO: 82; polynucleotides encoding the complementarity-determining regions (SEQ ID NO: 114; SEQ ID NO: 116; and SEQ ID NO: 118) of the light chain sequence of SEQ ID NO: 101 or the variable light chain sequence of SEQ ID NO: 102; polynucleotides encoding the framework regions (SEQ ID NO: 93; SEQ ID NO: 95; SEQ ID NO: 97; and SEQ ID NO: 99) of the heavy chain sequence of SEQ ID NO: 81 or the variable heavy chain sequence of SEQ ID NO: 82; and polynucleotides encoding the framework regions (SEQ ID NO: 113; SEQ ID NO: 115; SEQ ID NO: 117; and SEQ ID NO: 119) of the light chain sequence of SEQ ID NO: 101 or the variable light chain sequence of SEQ ID NO: 102.

In a preferred embodiment of the invention, polynucleotides of the invention comprise, or alternatively consist of, polynucleotides encoding Fab (fragment antigen binding) fragments having binding specificity for HGF. With respect to antibody Ab3, the polynucleotides encoding the full length Ab3 antibody comprise, or alternatively consist of, the polynucleotide SEQ ID NO: 91 encoding the heavy chain sequence of SEQ ID NO: 81 and the polynucleotide SEQ ID NO: 111 encoding the light chain sequence of SEQ ID NO: 101.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab3 following expression of the full-length polynucleotides in a suitable host. In another embodiment of the invention, anti-HGF antibodies such as Ab3 or Fab fragments thereof may be produced via expression of Ab3 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab4

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 121: cagtcgctggaggagtctgggggacgcttggtccagcctgggac- accctgacactctcctgtacagcctctggactcaccattag tagctac- tacat- gagctgggtccgtcaggctcagggaaggggctggagtgggtcggaaccat- caatcctggtgctaacacatact tcgcgagctctgcaaaaggccgattcac- catctccagatcctcgaccaccctggatcttaagatgaccagcccgacaga- gagga cactgctacatattactgtgctagagaggggatagtaatgactggggt- gtctttgacttgtggggccaagggaccctcgtcaccgt ctcgagcgc- ctccac- caaggggcccatcggtcttcccctggcaccctcctccaagagcacctc- tgggggcacagcggccctggg ctgcctggtcaaggactacttccccgaac- cggtgacggtgtcgtggaactcaggcgccctgaccagcggcgtgcacaccttc- ccg gctgtcctacagtcctcaggactctactccctcagcagcgtggtgaccgt- gccctccagcagcttgggcacccagacctacatctg caacgtgaatcaca- agc- ccagcaacaccaaggtggacaagagagttgagcccaaatcttgtgacaaaact- cacacatgcccacc gtgcccagcacctgaactcctgggggaccgtcagtct- tcctcttcccccaaaacccaaggacaccctcatgatctcccggaccc ctg- aggtcacatgcgtggtggtggacgtgagccacgaagacctgaggtcaagttc- aactggtacgtggacggcgtggaggtgc ataatgccaagacaaagccgcggg- aggagcagtacgccagcacgtaccgtgtggtcagcgtcctcaccgtcctgcac- caggact ggctgaatggcaaggagtacaagtgcaaggtctccaacaaagc- cctcccagcccccatcgagaaaaccatctccaaagccaaag ggcag- ccccga- gaaccacaggtgtacaccctgcccccatcccgggaggagatgaccaagaac- caggtcagcctgacctgcctg gtcaaaggcttctatcccagcgacatcgccg- tggagtgggagagcaatgggcagccggagaacaactacaagaccacgcctcc cgtgctggactccgacggctccttcttcctctacagcaagctcaccgtggacaa- gagcaggtggcagcaggggaacgtcttctcat gctccgtgatgcatgaggct- ctgcacaaccactacacgcagaagagcctctccctgtctccgggtaaa (SEQ ID NO: 131).

In another embodiment of the invention, the polynucleotides of the invention comprise, or alternatively consist of, the following polynucleotide sequence encoding the variable heavy chain polypeptide sequence of SEQ ID NO: 122: cagtcgctggaggagtctgggggacgcttggtccagcctgggacacccctga- cactctcctgtacagcctctggactcaccattag tagctactacatgag- ctgggtccgtcaggctccagggaaggggctggagtgggtcggaaccatcaat- cctggtgctaacacatact tcgcgagctctgcaaaaggccgattcaccatctc- cagatcctcgaccaccctggatcttaagatgaccagcccgacagctgagga cactgctacatattactgtgctagagaggggatagtaatgactggggtgtctttg- acttgtggggccaagggaccctcgtcaccgt ctcgagc (SEQ ID NO: 132).

In another embodiment of the invention, polynucleotides of the invention comprise, or alternatively consist of, the following polynucleotide sequence encoding the constant heavy chain polypeptide sequence of SEQ ID NO: 130: gcctccaccaagggcccatcggtcttcccctggcaccctcctccaagagcac- ctctgggggcacagcggccctgggctgcctg gtcaagga- ctacttc- cccgaaccggtgacggtgtcgtggaactcaggcgccctgaccagcggcgtg- cacaccttcccggctgtcc tacagtcctcaggactctactccctcagcagcgtg- gtgaccgtgccctccagcagcttgggcacccagacctacatctgcaacgtg aat- cacaagcccagcaacaccaaggtggacaagagagttgagcccaaatcttgt- gacaaaactcacacatgcccaccgtgccca gcacctgaactcctgggggac- cgtcagtcttcctcttcccccaaaacccaaggacaccctcatgatctcccggacc- cctgaggt cacatgcgtggtggtggacgtgagccacgaagacctgaggtca- agttcaactggtacgtggacggcgtggaggtgcataatgc caaga- caaagc- cgcgggaggagcagtacgccagcacgtaccgtgtggtcagcgtcctcac- cgtcctgcaccaggactggctga atggcaaggagtacaagtgcaaggtctc- caacaaagcccctcccagcccccatcgagaaaaccatctccaaagc- caaagggcag ccccgagaaccacaggtgtacaccctgcccccatcc- cgggaggagatgaccaagaaccaggtcagcctgacctgcctggtcaa aggct- tctatcccagcgacatcgccgtggagtgggagagcaatgggcagccg- gagaacaactacaagaccacgcctcccgtgct ggactccgacggctccttcttc- ctctacagcaagctcaccgtggacaagagcaggtggcagcaggggaacgtct- tctcatgctccg tgatgcatgaggctctgcacaaccactacacgcagaagagc- ctctccctgtctccgggtaaa (SEQ ID NO: 140).

In another embodiment of the invention, polynucleotides of the invention comprise, or alternatively consist of, the following polynucleotide sequence encoding the light chain polypeptide sequence of SEQ ID NO: 141: gcctatgatatgac- ccagtctccagcctccgtggaggcagccgtaggaggcacagtcaccatcaggt- gtcaggccagtgaggac attgaaagctacttagcctggtatcagcagaaacca- gggcagcctcctaagctcctgatctataggcatccgatctggcatctggg gtct- catcaaggttcaaaggcagtggatctgggacagattacactctcaccatcagcg- gcctggagcctgaagatgctgcaacttac tattgtcaacagggttatactatcga- taatgttgacaatacmcggcggaggaaccaaggtggaaatcaaacgtacgg- tagcggcc ccatctgtcttcatcttcccgccatctgatgagcagttgaaatct- ggaactgcctctgttgtgtgcctgctgaataacttctatcccagag aggccaaag- tacagtggaaggtggataacgccctccaatcgggtaactcccaggagagtgtcacagagcaggacagcaaggac agcacctacagcctcagcagcaccctgacgctgagcaaagcagactacgagaaacacaaagtctacgcctgcgaagtcaccat cagggcctgagctcgcccgtcacaaagagcttcaacaggggagagtgt (SEQ ID NO: 151).

In another embodiment of the invention, polynucleotides of the invention comprise, or alternatively consist of, the following polynucleotide sequence encoding the variable light chain polypeptide sequence of SEQ ID NO: 142: gcctatgatatgacccagtctccagcctccgtggaggcagccgtaggaggcacagtcaccatcaggtgtcaggccagtgaggac attgaaagctacttagcctggtatcagcagaaaccagggcagcctcctaagctcctgatctatagggcatccgatctggcatctggg gtctcatcaaggttcaaaggcagtggatctgggacagattacactctcaccatcagcggcctggagcctgaagatgctgcaacttactattgtcaacagggttatactatcgataatgttgacaatactttcggcggaggaaccaaggtggaaatcaaacgt (SEQ ID NO: 152).

In another embodiment of the invention, polynucleotides of the invention comprise, or alternatively consist of, the following polynucleotide sequence encoding the constant light chain polypeptide sequence of SEQ ID NO: 150: acggtagcggcccatctgtcttcatcttcccgccatctgatgagcagttgaaatctggaactgcctctgttgtgtgcctgctgaataa cttctatcccagag- aggccaaagtacagtggaaggtggataacgccctccaatcgggtaactcccaggagagtgtcacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 160).

In a further embodiment of the invention, polynucleotides encoding antibody fragments having binding specificity to HGF comprise, or alternatively consist of, one or more of the polynucleotide sequences of SEQ ID NO: 134; SEQ ID NO: 136; and SEQ ID NO: 138, which correspond to polynucleotides encoding the complementarity-determining regions (CDRs, or hypervariable regions) of the heavy chain sequence of SEQ ID NO: 121 or the variable heavy chain sequence of SEQ ID NO: 122, and/or one or more of the polynucleotide sequences of SEQ ID NO: 154; SEQ ID NO: 156; and SEQ ID NO: 158, which correspond to the complementarity-determining regions (CDRs, or hypervariable regions) of the light chain sequence of SEQ ID NO: 141 or the variable light chain sequence of SEQ ID NO: 142, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 133; SEQ ID NO: 135; SEQ ID NO: 137; and SEQ ID NO: 139, which correspond to polynucleotides encoding the framework regions (FRs or constant regions) of the heavy chain sequence of SEQ ID NO: 121 or the variable heavy chain sequence of SEQ ID NO: 122, and/or one or more of the polynucleotide sequences of SEQ ID NO: 153; SEQ ID NO: 155; SEQ ID NO: 157; and SEQ ID NO: 159, which correspond to the framework regions (FRs or constant regions) of the light chain sequence of SEQ ID NO: 141 or the variable light chain sequence of SEQ ID NO: 142, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 131 encoding the heavy chain sequence of SEQ ID NO: 121; the polynucleotide SEQ ID NO: 132 encoding the variable heavy chain sequence of SEQ ID NO: 122; the polynucleotide SEQ ID NO: 151 encoding the light chain sequence of SEQ ID NO: 141; the polynucleotide SEQ ID NO: 152 encoding the variable light chain sequence of SEQ ID NO: 142; polynucleotides encoding the complementarity-determining regions (SEQ ID NO: 134; SEQ ID NO: 136; and SEQ ID NO: 138) of the heavy chain sequence of SEQ ID NO: 121 or the variable heavy chain sequence of SEQ ID NO: 122; polynucleotides encoding the complementarity-determining regions (SEQ ID NO: 154; SEQ ID NO: 156; and SEQ ID NO: 158) of the light chain sequence of SEQ ID NO: 141 or the variable light chain sequence of SEQ ID NO: 142; polynucleotides encoding the framework regions (SEQ ID NO: 133; SEQ ID NO: 135; SEQ ID NO: 137; and SEQ ID NO: 139) of the heavy chain sequence of SEQ ID NO: 121 or the variable heavy chain sequence of SEQ ID NO: 122; and polynucleotides encoding the framework regions (SEQ ID NO: 153; SEQ ID NO: 155; SEQ ID NO: 157; and SEQ ID NO: 159) of the light chain sequence of SEQ ID NO: 141 or the variable light chain sequence of SEQ ID NO: 142.

In a preferred embodiment of the invention, polynucleotides of the invention comprise, or alternatively consist of, polynucleotides encoding Fab (fragment antigen binding) fragments having binding specificity for HGF. With respect to antibody Ab4, the polynucleotides encoding the full length Ab4 antibody comprise, or alternatively consist of, the polynucleotide SEQ ID NO: 131 encoding the heavy chain sequence of SEQ ID NO: 121 and the polynucleotide SEQ ID NO: 151 encoding the light chain sequence of SEQ ID NO: 141.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab4 following expression of the full-length polynucleotides in a suitable host. In another embodiment of the invention, anti-HGF antibodies such as Ab4 or Fab fragments thereof may be produced via expression of Ab4 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab5

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 161: cagtcgctggaggagtccgggggtcgcctggtcacgcctgggacaccctgacactcacctgcacagtactggattctccctcaa taattatgcagtgggctgggtccgccaggctccagggaaggggctggaatggatcggaatcatttaccttagtggtaacacagact acgcgaactgggcgaaaggccgattcaccatctccaaaacctcgaccacggtggatctgaaaatcaccagtccgacaaccgagg acacggccacctatttctgtgccaggaaatttgatacgggatatgacatctgg- ggcccaggcaccctcgtcaccgtctcgagcgcct ccaccaagggcccatcggtcttccccctggcacccctcctccaagagcacctctgggggcacagcggccctgggctgcctggtca aggactacttccccgaaccggtgacggtgtcgtggaactcaggcgccctgaccagcggcgtgcacaccttccggctgtcctaca gtcctcaggactctactccctcagcagcgtggtgaccgtgccctccagcagcttgggcacccagacctacatctgcaacgtgaatc acaagcccagcaacaccaaggtggacaagagagttgagcccaaatcttgtgacaaaactcacacatgcccaccgtgcccagcac ctgaactcctggggggaccgtcagtcttcctcttcccccaaaacccaaggacaccctcatgatctcccggacccctgaggtcaca tgcgtggtggtggacgtgagccacgaagaccctgaggtcaagttcaactggtacgtggacggcgtggaggtgcataatgccaag acaaagccgcgggaggagcagtacgccagcacgtaccgtgtggtcagcgtcctcaccgtcctgcaccaggactggctgaatgg caaggagtacaagtgcaaggtctccaacaaagccctcccagcccccatcgagaaaaccatctccaaagccaaagggcagccc gagaaccacaggtgtacaccctgcccccatcccgggaggagatgaccaagaaccaggtcagcctgacctgcctggtcaaaggc ttctatcccagcgacatcgccgtggagtgggagagcaatgggcagccggagaacaactacaagaccacgcctcccgtgctggac tccgacggctccttcttcctctacagcaagctcaccgtggacaagagcaggtggcagcaggggaacgtcttctcatgctccgtgat gcatgaggctctgcacaaccactacacgcagaagagcctctccctgtctccgggtaaa (SEQ ID NO: 171).

In another embodiment of the invention, the polynucleotides of the invention comprise, or alternatively consist of, the following polynucleotide sequence encoding the variable heavy chain polypeptide sequence of SEQ ID NO: 162: cagtcgctggaggagtccgggggtcgcctggtcacgcctgggacaccctgacactcacctgcacagtctctggattctccctcaa taattatgcagtgggctgggtcgccaggctccagggaaggggctggaatggatcggaatcatttaccttagtgtaacacagact acgcgaactgggcgaaaggccgattcaccatctccaaaacctcgaccacggtggatctgaaaatcaccagtccgacaaccgagg acacgccacctatttctgtgccaggaaatttgatacgggatatgacatctggggccagcaccctcgtcaccgtctcgagc (SEQ ID NO: 172).

In another embodiment of the invention, polynucleotides of the invention comprise, or alternatively consist of, the following polynucleotide sequence encoding the constant heavy chain polypeptide sequence of SEQ ID NO: 170: gcctccaccaagggcccatcggtcacccctggcaccctcctccaagagcacctctgggggcacagcggccctgggctgcctg gtcaaggactacttccc- cgaaccttccggtgacggtgtcgtggaactcaggcgccctgaccagcggcgtgcac- accttccggctgtcc tacagtcctcaggactctactccctcagcagcgtggtgaccgtgccctccagcagcttgggcacccagacctacatctgcaacgtg aatcaca- agcccagcaacaccaaggtggacaagagagttgagcccaaatcttgtgacaaaactcacacatgcccaccgtgccca gcacctgaactcctggggggaccgtcagtcttcctcttcccccaaaacccaaggacaccctcatgatctcccggacccctgaggtcacatgcgtggtggtggacgtgagccacgaagaccctgaggtcaagttcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagccctcccagcccccatcgagaaaaccatctccaaagccaaagggcag ccccgagaaccacaggtgtacaccctgcccccatcccgggaggagatgaccaagaaccaggtcagcctgacctgcctggtcaa aggcttctatcccagcgacatcgccgtggagtgggagagcaatgggcagccggagaacaactacaagaccacgcctcccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 180).

In another embodiment of the invention, polynucleotides of the invention comprise, or alternatively consist of, the following polynucleotide sequence encoding the light chain polypeptide sequence of SEQ ID NO: 181: gcctatga- tatgacccagactccagcctctatggaggtagagtgggaggcacagtcaccatcaagtgccaggccagtcagagca ttagtacctacttagcctggtatcagcagaaaccagggcagcctcccaagctcctgatctatgatgcatccgatctggcatctggggtctcatcgcggttcaaaggcagtggatctgggacacagttcactctcaccatcagcggcgtggagtgtgacgatgctgccacttacta ctgtcaacaggattggagtgatagtaatgagataatgattcggcggagggaccgaggtggtggtcaaacgtacggtagcggccc catctgtcttcatcttcccgccatctgatgagcagttgaaatctggaactgcctctgttgtgtgcctgctgaataacttctatcccagaga ggccaaagtacagtggaaggtggataacgccctccaatcgggtaactcccaggagagtgtcacagagcaggacagcaaggaca gcacctacagcctcagcagcaccctgacgctgagcaaagcagactacgagaaacacaaagtctacgcctgcgaagtcaccca tc agggcctgagctcgcccgtcacaaagagcttcaacaggggagagtgt (SEQ ID NO: 191).

In another embodiment of the invention, polynucleotides of the invention comprise, or alternatively consist of, the following polynucleotide sequence encoding the variable light chain polypeptide sequence of SEQ ID NO: 182: gcctatgatatgacccagactccagcctctatggaggtagctgtgggaggcacagtcaccatcaagtgccaggccagtcagagca ttagtacctacttagcctggtatcagcagaaaccagggcagcctcccaagctcctgatctatgatgcatccgatctggcatctggggt ctcatcgcggttcaaaggcagtggatctgggacacagttcact- ctcaccatcagcggcgtggagtgtgacgatgctgccacttacta ctgtcaacaggattggagtgatagtaatgttgataatgattcggcggagggaccgaggtggtggtcaaacgt (SEQ ID NO: 192).

In another embodiment of the invention, polynucleotides of the invention comprise, or alternatively consist of, the following polynucleotide sequence encoding the constant light chain polypeptide sequence of SEQ ID NO: 190: acggtagcggcccccatctgtcttcatcttcccgccatctgatgagcagttgaaatctggaactgcctctgttgtgtgcctgctgaataa cttctatcccagagaggccaaagtacagtggaaggtggataacgccctccaatcgggtaactcccaggagagtgtcacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 200).

In a further embodiment of the invention, polynucleotides encoding antibody fragments having binding specificity to HGF comprise, or alternatively consist of, one or more of the polynucleotide sequences of SEQ ID NO: 174; SEQ ID NO: 176; and SEQ ID NO: 178, which correspond to polynucleotides encoding the complementarity-determining regions (CDRs, or hypervariable regions) of the heavy chain sequence of SEQ ID NO: 161 or the variable heavy chain sequence of SEQ ID NO: 162, and/or one or more of the polynucleotide sequences of SEQ ID NO: 194; SEQ ID NO: 196; and SEQ ID NO: 198, which correspond to the complementarity-determining regions (CDRs, or hypervariable regions) of the light chain sequence of SEQ ID NO: 181 or the variable light chain sequence of SEQ ID NO: 182, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 173; SEQ ID NO: 175; SEQ ID NO: 177; and SEQ ID NO: 179, which correspond to polynucleotides encoding the framework regions (FRs or constant regions) of the heavy chain sequence of SEQ ID NO: 161 or the variable heavy chain sequence of SEQ ID NO: 162, and/or one or more of the polynucleotide sequences of SEQ ID NO: 193; SEQ ID NO: 195; SEQ ID NO: 197; and SEQ ID NO: 199, which correspond to the framework regions (FRs or constant regions) of the light chain sequence of SEQ ID NO: 181 or the variable light chain sequence of SEQ ID NO: 182, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 171 encoding the heavy chain sequence of SEQ ID NO: 161; the polynucleotide SEQ ID NO: 172 encoding the variable heavy chain sequence of SEQ ID NO: 162; the polynucleotide SEQ ID NO: 191 encoding the light chain sequence of SEQ ID NO: 181; the polynucleotide SEQ ID NO: 192 encoding the variable light chain sequence of SEQ ID NO: 182; polynucleotides encoding the complementarity-determining regions (SEQ ID NO: 174; SEQ ID NO: 176; and SEQ ID NO: 178) of the heavy chain sequence of SEQ ID NO: 161 or the variable heavy chain sequence of SEQ ID NO: 162; polynucleotides encoding the complementarity-determining regions (SEQ ID NO: 194; SEQ ID NO: 196; and SEQ ID NO: 198) of the light chain sequence of SEQ ID NO: 181 or the variable light chain sequence of SEQ ID NO: 182; polynucleotides encoding the framework regions (SEQ ID NO: 173; SEQ ID NO: 175; SEQ ID NO: 177; and SEQ ID NO: 179) of the heavy chain sequence of SEQ ID NO: 161 or the variable heavy chain sequence of SEQ ID NO: 162; and polynucleotides encoding the framework regions (SEQ ID NO: 193; SEQ ID NO: 195; SEQ ID NO: 197; and SEQ ID NO: 199) of the light chain sequence of SEQ ID NO: 181 or the variable light chain sequence of SEQ ID NO: 182.

In a preferred embodiment of the invention, polynucleotides of the invention comprise, or alternatively consist of, polynucleotides encoding Fab (fragment antigen binding) fragments having binding specificity for HGF. With respect to antibody Ab5, the polynucleotides encoding the full length Ab5 antibody comprise, or alternatively consist of, the polynucleotide SEQ ID NO: 171 encoding the heavy chain sequence of SEQ ID NO: 161 and the polynucleotide SEQ ID NO: 191 encoding the light chain sequence of SEQ ID NO: 181.

Another embodiment of the invention contemplates these polynucleotides incorporated into an expression vector for expression in mammalian cells such as CHO, NSO, HEK-293, or in fungal, insect, or microbial systems such as yeast cells such as the yeast Pichia. Suitable Pichia species include, but are not limited to, Pichia pastoris. In one embodiment of the invention described herein (infra), Fab fragments may be produced by enzymatic digestion (e.g., papain) of Ab5 following expression of the full-length polynucleotides in a suitable host. In another embodiment of the invention, anti-HGF antibodies such as Ab5 or Fab fragments thereof may be produced via expression of Ab5 polynucleotides in mammalian cells such as CHO, NSO or HEK 293 cells, fungal, insect, or microbial systems such as yeast cells (for example diploid yeast such as diploid Pichia) and other yeast strains. Suitable Pichia species include, but are not limited to, Pichia pastoris.

Antibody Ab6

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 201: cagtcggtggaggagtccggggtcgcctggtcatgcctggga-caccctgacactcacctgcaccgtctctggattctccctcag tagcaat-gcaataagctgggtccgccaggctccagagaaggggctggaatggatcggag-tcatttatgttattggtgtcactgacta cgcgagctgggcgcaaggccgattcac-catctccaaaacctcgaccacggtggatctgaaaatcccccagtccgacaac-cgagga cacggccacctatttctgtgccagagtttatgattctggctggaatc-actttaacttgtggggcccgggcaccctcgtcaccgtctcga gcgcctcca-ccaagggcccatcggtcttcccctggcaccctcctccaagagcacctctggg-ggcacagcggccctgggctgcc tggtcaaggactacttccccgaaccg-gtgacggtgtcgtggaactcaggcgccctgaccagcggcgtgcacaccacccg-gctgt cctacagtcctcaggactctactccctcagcagcgtggtgaccgtgc-caccagcagcttgggcacccagacctacatctgcaacg tgaatcacaagccca-gcaacaccaaggtggacaagagagttgagcccaaatcttgtgacaaaactca-cacatgcccaccgtgccc agcacctgaactcctgggggaccgtcagtctt-cctatccccccaaaacccaaggacacccctcatgatctcccggacccctgagg-tcacatgcgtggtggtggacgtgagccacgaagaccctgaggtcaagttcaac-tggtacgtggacggcgtggaggtgcataatgc caagacaaagccgcgggag-gagcagtacgccagcacgtaccgtgtggtcagcgtcctcaccgtcctgcacca-ggactggctga atggcaaggagtacaagtgcaaggtctccaacaaagccct-cccagccccatcgagaaaaccatctccaaagccaaagggcag ccccga-gaaccacaggtgtacaccctgccccccatcccgggaggagatgaccaagaacc-aggtcagcctgacctgcctggtcaa aggcttctatcccagcgacatcgccgtg-gagtgggagagcaatgggcagccggagaacaactacaagaccacgcctc-ccgtgct ggactccgacggctccttcttcctctacagcaagctcaccgtgg-acaagagcaggtggcagcaggggaacgtcttctcatgctccg tgatgcatgag-gctctgcacaaccactacacgcagaagagcctctccctgtctccgggtaaa (SEQ ID NO: 211).

In another embodiment of the invention, the polynucleotides of the invention comprise, or alternatively consist of, the following polynucleotide sequence encoding the variable heavy chain polypeptide sequence of SEQ ID NO: 202: cagtcggtggaggagtccggggtcgcctggtcatgcctgggacaccccctgac-actcacctgcaccgtctctggattctccctcag tagcaatgcaataagctgggtc-cgccaggctccagagaaggggctggaatggatcggagtcatttatgttattggtgt-cactgacta cgcgagctgggcgcaaggccgattcaccatctccaaaacctc-gaccacggtggatctgaaaatcccccagtccgacaaccgagga cacggcca-cctatttctgtgccagagtttatgattctggctggaatcactttaacttgtggggcc-cgggcaccctcgtcaccgtctcga gc (SEQ ID NO: 212).

In another embodiment of the invention, polynucleotides of the invention comprise, or alternatively consist of, the following polynucleotide sequence encoding the constant heavy chain polypeptide sequence of SEQ ID NO: 210: gcctccaccaagggcccatcggtcttcccctggcaccctcctccaagagcacct-ctggggcacagcggccctgggctgcctggtcaaggactacttccccgaac-cggtgacggtgtcgtggaactcaggcgccctgaccagcggcgtgcacacct-teccggctgtcc tacagtcctcaggactctactccctcagcagcgtggtgaccgt-gccctccagcagcttgggcacccagacctacatctgcaacgtg aatcacaagc-ccagcaacaccaaggtggacaagagagttgagcccaaatcttgtgacaaaact-cacacatgcccaccgtgccca gcacctgaactcctgggggaccgtcagtct-tcctcttcccccaaaacccaaggacacccctcatgatctcccggacccctgaggt-cacatgcgtggtggtggacgtgagccacgaagaccctgaggtcaagttcaactg-gtacgtggacggcgtggaggtgcataatgc caagacaaagccgcggg-aggagcagtacgccagcacgtaccgtgtggtcagcgtcctcaccgtcctgcac-caggactggctga atggcaaggagtacaagtgcaaggtctccaacaaagc-cctcccagccccatcgagaaaaccatctccaaagccaaagggcagccccga-gaaccacaggtgtacaccctgccccccatcccgggaggagatgaccaagaac-caggtcagcctgacctgcctggtcaa aggcttctatcccagcgacatcgccgt-ggagtgggagagcaatgggcagccggagaacaactacaagaccacgcctcccgtgct ggactccgacggctccttcttcctctacagcaagctcaccgtggacaagagcaggtggcagcaggggaacgtcttctcatgctccg tgatgcatgagctctgcacaaccactacacgcagaagagcctctccctgtctccgggtaaa (SEQ ID NO: 220).

In another embodiment of the invention, polynucleotides of the invention comprise, or alternatively consist of, the following polynucleotide sequence encoding the light chain polypeptide sequence of SEQ ID NO: 221: gctgacatt- gtgatgacccagactccatcctccgtggaggcagctgtgggaggcacagtcaccatcaagtgccaggccagtgaga acatttataggttattggcctggtatcagcagaaaccagggcagcgtcccaagctcctgatctattctgcatccactctgcatctggg gtcccatcgcggttcaaaggcagtggatctgggacacagttcactctcaccatcagcgacctggagtgtgccgatgctgccactta ctactgtcaaaactattattatagtagtaggagtagttatgatacatataatgattcggcggagggaccgaggtggtggtcaaacgta cggtagcggcccatctgtcttcatcttcccgccatctgatgagcagttgaaatctggaactgcctctgttgtgtgcctgctgaataactctatcccagagaggccaaagtacagtggaaggtggataacgccctccaatcgggtaactcccaggagagtgtcacagagcagg acagcaaggacagcacctacagcctcagcagcaccctgacgctgagcaaagcagactacgagaaacacaaagtctacgcctgc gaagtcacccatcagggcctgagctcgcccgtcacaaagagct- tcaacaggggagagtgt (SEQ ID NO: 231).

In another embodiment of the invention, polynucleotides of the invention comprise, or alternatively consist of, the following polynucleotide sequence encoding the variable light chain polypeptide sequence of SEQ ID NO: 222: gctgacattgtgatgacccagactccatcctccgtggaggcagctgtgggaggcacagtcaccatcaagtgccaggccagtgaga acatttataggttattggcctg- gtatcagcagaaaccagggcagcgtcccaagacctgatctattctgcatccactctggcatctggg gtcccatcgcggttcaaaggcagtggatctgggacacagttc- actctcaccatcagcgacctggagtgtgccgatgctgccactta ctactgtca- aaactattattatagtagtaggagtagttatgatacatataatgtttcggcggagg- gaccgaggtggtggtcaaacgt (SEQ ID NO: 232).

In another embodiment of the invention, polynucleotides of the invention comprise, or alternatively consist of, the following polynucleotide sequence encoding the constant light chain polypeptide sequence of SEQ ID NO: 230: acggtagcggcccatctgtcttcatcttcccgccatctgatgagcagttgaaatctggaactgcctctgttgtgtgcctgctgaataa cactatcccagagaggccaaagtacagtggaaggtggataacgccaccaatcgggtaactcccaggagagtgtcacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 240).

In a further embodiment of the invention, polynucleotides encoding antibody fragments having binding specificity to HGF comprise, or alternatively consist of, one or more of the polynucleotide sequences of SEQ ID NO: 214; SEQ ID NO: 216; and SEQ ID NO: 218, which correspond to polynucleotides encoding the complementarity-determining regions (CDRs, or hypervariable regions) of the heavy chain sequence of SEQ ID NO: 201 or the variable heavy chain sequence of SEQ ID NO: 202, and/or one or more of the polynucleotide sequences of SEQ ID NO: 234; SEQ ID NO: 236; and SEQ ID NO: 238, which correspond to the complementarity-determining regions (CDRs, or hypervariable regions) of the light chain sequence of SEQ ID NO: 221 or the variable light chain sequence of SEQ ID NO: 222, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 213; SEQ ID NO: 215; SEQ ID NO: 217; and SEQ ID NO: 219, which correspond to polynucleotides encoding the framework regions (FRs or constant regions) of the heavy chain sequence of SEQ ID NO: 201 or the variable heavy chain sequence of SEQ ID NO: 202, and/or one or more of the polynucleotide sequences of SEQ ID NO: 233; SEQ ID NO: 235; SEQ ID NO: 237; and SEQ ID NO: 239, which correspond to the framework regions (FRs or constant regions) of the light chain sequence of SEQ ID NO: 221 or the variable light chain sequence of SEQ ID NO: 222, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 211 encoding the heavy chain sequence of SEQ ID NO: 201; the polynucleotide SEQ ID NO: 212 encoding the variable heavy chain sequence of SEQ ID NO: 202; the polynucleotide SEQ ID NO: 231 encoding the light chain sequence of SEQ ID NO: 221; the polynucleotide SEQ ID NO: 232 encoding the variable light chain sequence of SEQ ID NO: 222; polynucleotides encoding the complementarity-determining regions (SEQ ID NO: 214; SEQ ID NO: 216; and SEQ ID NO: 218) of the heavy chain sequence of SEQ ID NO: 201 or the variable heavy chain sequence of SEQ ID NO: 202; polynucleotides encoding the complementarity-determining regions (SEQ ID NO: 234; SEQ ID NO: 236; and SEQ ID NO: 238) of the light chain sequence of SEQ ID NO: 221 or the variable light chain sequence of SEQ ID NO: 222; polynucleotides encoding the framework regions (SEQ ID NO: 213; SEQ ID NO: 215; SEQ ID NO: 217; and SEQ ID NO: 219) of the heavy chain sequence of SEQ ID NO: 201 or the variable heavy chain sequence of SEQ ID NO: 202; and polynucleotides encoding the framework regions (SEQ ID NO: 233; SEQ ID NO: 235; SEQ ID NO: 237; and SEQ ID NO: 239) of the light chain sequence of SEQ ID NO: 221 or the variable light chain sequence of SEQ ID NO: 222.

In a preferred embodiment of the invention, polynucleotides of the invention comprise, or alternatively consist of, polynucleotides encoding Fab (fragment antigen binding) fragments having binding specificity for HGF. With respect to antibody Ab6, the polynucleotides encoding the full length Ab6 antibody comprise, or alternatively consist of, the polynucleotide SEQ ID NO: 211 encoding the heavy chain sequence of SEQ ID NO: 201 and the polynucleotide SEQ ID NO: 231 encoding the light chain sequence of SEQ ID NO: 221.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab6 following expression of the full-length polynucleotides in a suitable host. In another embodiment of the invention, anti-HGF antibodies such as Ab6 or Fab fragments thereof may be produced via expression of Ab6 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab7

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 241: cagtcggtggaggagtccgggggtcgcctggtcatgcctgg-gacaccctgacactcacctgcaccgtctctggattctccctcag tagcaatgc-aataagctgggtccgccaggctccagagaaggggctggaatggatcggagtc-atttatgttattggtgtcactgacta cgcgagctgggcgcaaggccgattcac-catctccaaaacctcgaccacggtggatctgaaaatccccagtccgacaac-cgagga cacggccacctatttctgtgccagagttatgattctggctgga-atcactttaacttgtggggcccagggaccctcgtcaccgtctcga gcgc- ctc-caccaagggcccatcggtcttcccctggcacccctcctccaagaggcaccctc-tgggggcacagcggccctgggctgcc tggtcaaggactacttccccgaaccg-gtgacggtgtcgtggaactcaggcgccctgaccagcggcgtgcacaccttcccg-gctgt cctacagtcctcaggactctactccctcagcagcgtggtgaccgtgc-cctccagcagcttgggcacccagacctacatctgcaacg tgaatcacaagcc-cagcaacaccaaggtggacaagagagttgagcccaaatcttgtgacaaaact-cacacatgcccaccgtgccc agcacctgaactcctgggggaccgtcagtct-tcctcttccccccaaaacccaaggacaccctcatgatctcccggacccctgagg-tcacatgcgtggtggtggacgtgagccacgaagaccctgaggtcaagttcaact-ggtacgtggacggcgtggaggtgcataatgc caagacaaagccgcggga-ggagcagtacgccagcacgtaccgtgtggtcagcgtcctcaccgtcctgcacca-ggactggctga atggcaaggagtacaagtgcaaggtctccaacaaagccctc-ccagcccccatcgagaaaaccataccaaagccaaagggcag ccccgagaa-ccacaggtgtacaccctgcccccatcccgggaggagatgaccaagaaccaggt-cagcctgacctgcctggtcaa aggcttctatcccagcgacatcgccgtggagt-gggagagcaatgggcagccggagaacaactacaagaccacgcctcccgtgct-ggactccgacggctccttcttcctctacagcaagctcaccgtggacaagagcagg-tggcagcaggggaacgtatctcatgaccg tgatgcatgaggctctgcacaac-cactacacgcagaagagcctctccctgtctccgggtaaa (SEQ ID NO: 251).

In another embodiment of the invention, the polynucleotides of the invention comprise, or alternatively consist of, the following polynucleotide sequence encoding the variable heavy chain polypeptide sequence of SEQ ID NO: 242: cagtcggtggaggagtccgggggtcgcctggtcatgcctgggacaccctgac-actcacctgcaccgtactggattctccctcag tagcaatgcaataagctgggtc-cgccaggaccagagaaggggctggaatggatcggagtcatttatgttattggtg-tcactgacta cgcgagctgggcgcaaggccgattcaccatctccaaaacctc-gaccacggtggatctgaaaatccccagtccgacaaccgagga cacggccacc-tatttctgtgccagagtttatgattctggctggaatcactttaacttgtggggcccagg-gaccctcgtcaccgtctcga gc (SEQ ID NO: 252).

In another embodiment of the invention, polynucleotides of the invention comprise, or alternatively consist of, the following polynucleotide sequence encoding the constant heavy chain polypeptide sequence of SEQ ID NO: 250: gcctccaccaagggcccatcggtcttcccctggcacccctcctccaagagcacc-tctgggggcacagcggccctgggctgcctg gtcaaggactacttccccga-accggtgacggtgtcgtggaactcaggcgccctgaccagcggcgtgcacacctt-cccggctgtcc tacagtcctcaggactctactccctcagcagcgtggtgaccgt-gccctccagcagcttgggcacccagacctacatctgcaacgtg aatcacaagc-ccagcaacaccaaggtggacaagagagttgagcccaaatcttgtgacaaaact-cacacatgcccaccgtgccca gcacctgaactcctgggggaccgtcagtcttc-ctcttccccccaaaacccaaggacaccctcatgatctcccggacccctgaggt-cacatgcgtggtggtggacgtgagccacgaagaccctgaggtcaagttcaact-ggtacgtggacggcgtggaggtgcataatgc caagacaaagccgcgggag-gagc- agtacgccagcacgtaccgtgtggtcagcgtcctcaccgtcctgcacca-ggactggctga atggcaaggagtacaagtgcaaggtctccaacaaagccctc-ccagcccccatcgagaaaaccatctccaaagccaaagggcag ccccga-gaaccacaggtgtacaccctgcccccatcccgggaggagatga caagaac-caggtcagcctgacctgcctggtcaa aggcttctatcccagcgacatcgccgtg-gagtgggagagcaatgggcagccggagaacaactacaagaccacgcctcccgt-gct ggactccgacggctccttcttcctctacagcaagctcaccgtggacaagag-caggtggcagcaggggaacgtcttctcatgctccg tgatgcatgaggctctgca-caaccactacacgcagaagagcctctccctgtctccgggtaaa (SEQ ID NO: 260).

In another embodiment of the invention, polynucleotides of the invention comprise, or alternatively consist of, the following polynucleotide sequence encoding the light chain polypeptide sequence of SEQ ID NO: 261: gcctatgatatgac-ccagactccagcctctgtggaggtagctgtgggaggcacagtcaccatcaagtg-ccaggccagtcagagca ttagcagttggttagcctggtatcagcagaaacca-gggcagcctccaaagctcctgatctacgaagcatccaaactggcatctggg-gtcccatcgcggttcagtggcagtggatctgggacacagttcactctcaccatca-gcggcgtggagtgtgccgatgctgccactta ctactgtcaacaggcttatagtgtt-gccaatgttgataatgctttcggcggagggaccgaggtggtcaaacgtacgg-tagcggc cccatctgtcttcatcttcccgccatctgatgagcagttgaaatctg-gaactgcctctgttgtgtgcctgctgaataacttctatcccaga gaggccaa-agtacagtggaaggtggataacgccaccaatcgggtaactcccaggagagtgt-cacagagcaggacagcaagga cagcacctacagcctcagcagcaccct-gacgctgagcaaagcagactacgagaaacacaaagtctacgcctgcgaagt-caccc atcagggcctgagctcgcccgtcacaaagagcttcaacaggggga-gagtgt (SEQ ID NO: 271).

In another embodiment of the invention, polynucleotides of the invention comprise, or alternatively consist of, the following polynucleotide sequence encoding the variable light chain polypeptide sequence of SEQ ID NO: 262: gcctatgatatgacccagactccagcctctgtggaggtagctgtgggaggcacag-tcaccatcaagtgccaggccagtcagagca ttagcagttggttagcctggtatca-gcagaaaccagggcagcctccaaagctcctgatctacgaagcatccaaactg-gcatctggg gtcccatcgcggttcagtggcagtggatctgggacacagttcactc-tcaccatcagcggcgtggagtgtgccgatgctgccactta ctactgtcaacag-gcttatagtgttgccaatgttgataatgctttcggcggagggaccgaggtggtg-gtcaaacgt (SEQ ID NO: 272).

In another embodiment of the invention, polynucleotides of the invention comprise, or alternatively consist of, the following polynucleotide sequence encoding the constant light chain polypeptide sequence of SEQ ID NO: 270: acggtagcggcccccatctgtcttcatcacccgccatctgatgagcagttgaaatct-ggaactgcctctgttgtgtgcctgctgaataa cactatcccagagaggccaaag-tacagtggaaggtggataacgccaccaatcgggtaactcccaggagagtgt-cacagagca ggacagcaaggacagcacctacagcctcagcagcaccct-gacgctgagcaaagcagactacgagaaacacaaagtctacgcct gcgaagt-cacccatcagggcctgagctcgcccgtcacaaagagcttcaacaggggagagtgt (SEQ ID NO: 280).

In a further embodiment of the invention, polynucleotides encoding antibody fragments having binding specificity to HGF comprise, or alternatively consist of, one or more of the polynucleotide sequences of SEQ ID NO: 254; SEQ ID NO: 256; and SEQ ID NO: 258, which correspond to polynucleotides encoding the complementarity-determining regions (CDRs, or hypervariable regions) of the heavy chain sequence of SEQ ID NO: 241 or the variable heavy chain sequence of SEQ ID NO: 242, and/or one or more of the polynucleotide sequences of SEQ ID NO: 274; SEQ ID NO: 276; and SEQ ID NO: 278, which correspond to the complementarity-determining regions (CDRs, or hypervariable regions) of the light chain sequence of SEQ ID NO: 261 or the variable light chain sequence of SEQ ID NO: 262, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of one or more of the polynucleotide sequences of SEQ ID NO: 253; SEQ ID NO: 255; SEQ ID NO: 257; and SEQ ID NO: 259, which correspond to polynucleotides encoding the framework regions (FRs or constant regions) of the heavy chain sequence of SEQ ID NO: 241 or the variable heavy chain sequence of SEQ ID NO: 242, and/or one or more of the polynucleotide sequences of SEQ ID NO: 273; SEQ ID NO: 275; SEQ ID NO: 277; and SEQ ID NO: 279, which correspond to the framework regions (FRs or constant regions) of the light chain sequence of SEQ ID NO: 261 or the variable light chain sequence of SEQ ID NO: 262, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 251 encoding the heavy chain sequence of SEQ ID NO: 241; the polynucleotide SEQ ID NO: 252 encoding the variable heavy chain sequence of SEQ ID NO: 242; the polynucleotide SEQ ID NO: 271 encoding the light chain sequence of SEQ ID NO: 261; the polynucleotide SEQ ID NO: 272 encoding the variable light chain sequence of SEQ ID NO: 262; polynucleotides encoding the complementarity-determining regions (SEQ ID NO: 254; SEQ ID NO: 256; and SEQ ID NO: 258) of the heavy chain sequence of SEQ ID NO: 241 or the variable heavy chain sequence of SEQ ID NO: 242; polynucleotides encoding the complementarity-determining regions (SEQ ID NO: 274; SEQ ID NO: 276; and SEQ ID NO: 278) of the light chain sequence of SEQ ID NO: 261 or the variable light chain sequence of SEQ ID NO: 262; polynucleotides encoding the framework regions (SEQ ID NO: 253; SEQ ID NO: 255; SEQ ID NO: 257; and SEQ ID NO: 259) of the heavy chain sequence of SEQ ID NO: 241 or the variable heavy chain sequence of SEQ ID NO: 242; and polynucleotides encoding the framework regions (SEQ ID NO: 273; SEQ ID NO: 275; SEQ ID NO: 277; and SEQ ID NO: 279) of the light chain sequence of SEQ ID NO: 261 or the variable light chain sequence of SEQ ID NO: 262.

In a preferred embodiment of the invention, polynucleotides of the invention comprise, or alternatively consist of, polynucleotides encoding Fab (fragment antigen binding) fragments having binding specificity for HGF. With respect to antibody Ab7, the polynucleotides encoding the full length Ab7 antibody comprise, or alternatively consist of, the polynucleotide SEQ ID NO: 251 encoding the heavy chain sequence of SEQ ID NO: 241 and the polynucleotide SEQ ID NO: 271 encoding the light chain sequence of SEQ ID NO: 261.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab7 following expression of the full-length polynucleotides in a suitable host. In another embodiment of the invention, anti-HGF antibodies such as Ab7 or Fab fragments thereof may be produced via expression of Ab7 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab8

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 281: gaggtgcagctggtggagtctgggggaggcaggtccagcctg-ggggtccctgagactacctgtgcagcctctggattcaccg tcagtagcaatgc-aataagagggtccgtcaggctccagggaaggggctggagtgggtcggagtcatt-tatgttattggtgtcactg actacgcgagctctgcgcaaggccgattcaccatctc-cagagacaattccaagaacaccctgtatcttcaaatgaacagcctgaga gctga-ggacactgctgtgtattactgtgctagagtttatgattctggctggaatcactttaact-tgtggggccaagggaccctcgtcac cgtctcgagcgcctccaccaagggc-ccatcggtcttccccctggcaccctcctccaagagcacctctgggggcaca-gcggccct gggctgctggtcaaggactacttccccgaaccggtgacggtgtcgt-ggaactcaggcgccctgaccagcggcgtgcacaccttt cccggctgtcctaca-gtcctcaggactctactccctcagcagcgtggtgaccgtgccctccagcagcttg-ggcacccagacctaca tctgcaacgtgaatcacaagcccagcaacac-caaggtggacaagagagttgagcccaaatcttgtgacaaaactcacacatgccc-accgtgcccagcacctgaactcctggggggaccgtcagtatcctcttcccccca-aaacccaaggacaccctcatgatctcccgga cccctgaggtcacatgcgtggtg-gtggacgtgagccacgaagaccctgaggtcaagttcaactggtacgtggacg-gcgtggagg tgcataatgccaagacaaagccgcgggaggagcagtacgccag-cacgtaccgtgtggtcagcgtcctcaccgtcctgcaccagg actggctgaatg-gcaaggagtacaagtgcaaggtaccaacaaagccctcccagccccatcga-gaaaaccatctccaaagcca aaggggcagccccgagaaccacaggtgtacac-cctgcccccatcccgggaggagatgaccaagaaccaggtcagcctgacctg-cctggtcaaaggcttctatcccagcgacatcgccgtggagtgggagagcaatgg-gcagccggagaacaactacaagaccacgc ctcccgtgctggactccgacg-gctccttcttcctctacagcaagctcaccgtggacaagagcaggtggcagca-ggggaacgtcttc tcatgctccgtgatgcatgaggctctgcacaaccacta-cacgcagaagagcctctccctgtctccgggtaaa (SEQ ID NO: 291).

In another embodiment of the invention, the polynucleotides of the invention comprise, or alternatively consist of, the following polynucleotide sequence encoding the variable heavy chain polypeptide sequence of SEQ ID NO: 282: gaggtgcagctggtggagtctgggggaggcttggtccagcctggggggtccct-gagactctcctgtgcagcctctggattcaccg tcagtagcaatgcaataagc-tgggtccgtcaggctccagggaaggggctggagtgggtcggagtcatttatgt-tattggtgtcactg actacgcgagactgcgcaaggccgattcaccatctccaga-gacaattccaagaacaccctgtatcttcaaatgaacagcctgaga gctgaggac-actgctgtgtattactgtgctagagtttatgattctggctggaatcactttaacttgtg-gggccaagggaccacgtcac cgtctcgagc (SEQ ID NO: 292).

In another embodiment of the invention, polynucleotides of the invention comprise, or alternatively consist of, the following polynucleotide sequence encoding the constant heavy chain polypeptide sequence of SEQ ID NO: 290: gcctccaccaagggcccatcggtatcccctggcaccctcctccaagagcacctctggggcacagcggccctgggctgcctg gtcaaggactacttccccgaaccggtgacggtgtcgtggaactcaggcgccctgaccagcggcgtgcacaccaccggctgtcc tacagtcctcaggactctactccctcagcagcgtggtgaccgtgccctccagcagcttgggcacccagacctacatctgcaacgtg aatcaagcccagcaacaccaaggtggacaagagagttgagcccaaatcttgtgacaaaactcacacatgccaccgtgccca gcacctgaactcctgggggaccgtcagtcttcctcttcccccaaaacccaaggacaccctcatgatctcccggacccctgaggtcacatgcgtggtggtggacgtgagccacgaagacctgaggtcaagttcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagccctcccagcccccatcgagaaaaccatctccaaagccaaagggcag ccccgagaaccacaggtgtacaccctgcccccatcccgggaggagatgaccaagaaccaggtcagcctgacctgcctggtcaa aggcttctatcccagcgacatcgccgtggagtgggagagcaatgggcagccggagaacaactacaagaccacgcctccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 300).

In another embodiment of the invention, polynucleotides of the invention comprise, or alternatively consist of, the following polynucleotide sequence encoding the light chain polypeptide sequence of SEQ ID NO: 301: gacatccagatgacccagtctccaccaccctgtctgcatctgtaggagacagagtcaccatcacttgccaggccagtcagagcatt agcagttggttagcctggtatcagcagaaaccaggaaaagcccctaagctcctgatctatgaagcatccaaactggcatctggagt ccca tcaaggttcagcggcagtggatctggaacagaattcactctcaccatcagcagcctgcagcctgatgattttgcaacttattact gccaacaggcttatagtgagccaatgttgataatgctttcggcggaggaaccaaggtggaaatcaaacgtacggtagcggcccca tctgtcttcatcttcccgccatctgatgagcagttgaaatctggaactgcctctgttgtgtgcctgctgaataacttctatcccagagagg ccaaagtacagtggaaggtggataacgccctccaatcgggtaactccaggagagtgtcacagagcaggacagcaaggacagc acctacagcctcagcagcaccctgacgctgagcaaagcagactacgagaaacacaaagtctacgcctgcgaagtcacccatcag ggcctgagctcgcccgtcacaaagagcttcaacaggggagagtgt (SEQ ID NO: 311).

In another embodiment of the invention, polynucleotides of the invention comprise, or alternatively consist of, the following polynucleotide sequence encoding the variable light chain polypeptide sequence of SEQ ID NO: 302: gacatccagatgacccagtctccttccaccctgtctgcatctgtaggagacagagtcaccatcacttgccaggccagtcagagcatt agcagttggttagcctgg tatcagcagaaaccaggaaaagcccctaagctcctgatctatgaagcatccaaactggcatctggagt cccatcaaggttcagcggcagtggatctggaacagaattcactctcaccatcagcagcctgcagcctgatgattttgcaacttattact gccaacaggcttatagtgttgccaatgttgataatgctttcggcggaggaaccaaggtggaaatcaaacgt (SEQ ID NO: 312).

In another embodiment of the invention, polynucleotides of the invention comprise, or alternatively consist of, the following polynucleotide sequence encoding the constant light chain polypeptide sequence of SEQ ID NO: 310: acggtagcggcccccatctgtcttcatatcccgccatctgatgagcagttgaaatctggaactgcctctgagtgtgcctgctgaataa cttctatcccagagaggccaaagtacagtggaaggtggataacgccaccaatcgggtaactccaggagagtgtcacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 320).

In a further embodiment of the invention, polynucleotides encoding antibody fragments having binding specificity to HGF comprise, or alternatively consist of, one or more of the polynucleotide sequences of SEQ ID NO: 294; SEQ ID NO: 296; and SEQ ID NO: 298, which correspond to polynucleotides encoding the complementarity-determining regions (CDRs, or hypervariable regions) of the heavy chain sequence of SEQ ID NO: 281 or the variable heavy chain sequence of SEQ ID NO: 282, and/or one or more of the polynucleotide sequences of SEQ ID NO: 314; SEQ ID NO: 316; and SEQ ID NO: 318, which correspond to the complementarity-determining regions (CDRs, or hypervariable regions) of the light chain sequence of SEQ ID NO: 301 or the variable light chain sequence of SEQ ID NO: 302, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 293; SEQ ID NO: 295; SEQ ID NO: 297; and SEQ ID NO: 299, which correspond to polynucleotides encoding the framework regions (FRs or constant regions) of the heavy chain sequence of SEQ ID NO: 281 or the variable heavy chain sequence of SEQ ID NO: 282, and/or one or more of the polynucleotide sequences of SEQ ID NO: 313; SEQ ID NO: 315; SEQ ID NO: 317; and SEQ ID NO: 319, which correspond to the framework regions (FRs or constant regions) of the light chain sequence of SEQ ID NO: 301 or the variable light chain sequence of SEQ ID NO: 302, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 291 encoding the heavy chain sequence of SEQ ID NO: 281; the polynucleotide SEQ ID NO: 292 encoding the variable heavy chain sequence of SEQ ID NO: 282; the polynucleotide SEQ ID NO: 311 encoding the light chain sequence of SEQ ID NO: 301; the polynucleotide SEQ ID NO: 312 encoding the variable light chain sequence of SEQ ID NO: 302; polynucleotides encoding the complementarity-determining regions (SEQ ID NO: 294; SEQ ID NO: 296; and SEQ ID NO: 298) of the heavy chain sequence of SEQ ID NO: 281 or the variable heavy chain sequence of SEQ ID NO: 282; polynucleotides encoding the complementarity-determining regions (SEQ ID NO: 314; SEQ ID NO: 316; and SEQ ID NO: 318) of the light chain sequence of SEQ ID NO: 301 or the variable light chain sequence of SEQ ID NO: 302; polynucleotides encoding the framework regions (SEQ ID NO: 293; SEQ ID NO: 295; SEQ ID NO: 297; and SEQ ID NO: 299) of the heavy chain sequence of SEQ ID NO: 281 or the variable heavy chain sequence of SEQ ID NO: 282; and polynucleotides encoding the framework regions (SEQ ID NO: 313; SEQ ID NO: 315; SEQ ID NO: 317; and SEQ ID NO: 319) of the light chain sequence of SEQ ID NO: 301 or the variable light chain sequence of SEQ ID NO: 302.

In a preferred embodiment of the invention, polynucleotides of the invention comprise, or alternatively consist of, polynucleotides encoding Fab (fragment antigen binding) fragments having binding specificity for HGF. With respect to antibody Ab8, the polynucleotides encoding the full length Ab8 antibody comprise, or alternatively consist of, the polynucleotide SEQ ID NO: 291 encoding the heavy chain sequence of SEQ ID NO: 281 and the polynucleotide SEQ ID NO: 311 encoding the light chain sequence of SEQ ID NO: 301.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab8 following expression of the full-length polynucleotides in a suitable host. In another embodiment of the invention, anti-HGF antibodies such as Ab8 or Fab fragments thereof may be produced via expression of Ab8 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab9

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 321: cagtcggtggaggagtccggggtcgcctggtcacgcctggga- cacccctgacactcacctgcacagtgtctggaatcgacctc aatagcaat- ggaatgagctgggtccgccaggctccaggggaggggctggaatggatcggag- ccagtagtattgatgggaccac atactacaccaattgggcgaagggccgattcac- catctccaaaacctcgtcgaccacggtggatctgaaaatcaccagtccgacaa- ccgaggacacggccaccctatttctgtaccagaggggagtatgctggtgttgttgg- ttcgaactactttgacttgtggggccagggca ccctcgtcaccgtctcgagcgc- ctccaccaagggcccatcggtcttccccctggcaccctcctccaagagcac- ctctgggggcac agcggccctgggctgcctggtcaaggactacttc- cccgaaccggtgacggtgtcgtggaactcaggcgccctgaccagcggcgt- gcacaccttccggctgtcctacagtcctcaggactctactccctcagcagcgtg- gtgaccgtgccctccagcagcttgggcaccc agacctacatctgcaacgt- gaatcacaagcccagcaacaccaaggtggacaagagagttgagcccaaatctt- gtgacaaaactca cacatgcccaccgtgcccagcacctgaactc- ctgggggaccgtcagtcttcctcttcccccaaaacccaaggacaccctcatg- atctcccggacccctgaggtcacatgcgtggtggtggacgtgagccacgaaga- ccctgaggtcaagttcaactggtacgtggacg gcgtggaggtgcataatgc- caagacaaagccgcgggaggagcagtacgccagcacgtaccgtgtggtcag- cgtcctcaccgtc ctgcaccaggactggctgaatggcaaggagtacaagtgcaa- ggtctccaacaaagcccctcccagcccccatcgagaaaaccatc tccaaagc- caaa gggcagccccgagaaccacaggtgtacaccctgcccccatc- ccgggaggagatgaccaagaaccaggtca gcctgacctgcctggtcaaggct- tctatcccagcgacatcgccgtggagtgggagagcaatgggcagccgga- gaacaactaca agaccacgcctcccgtgctggactccgacggctccttcttc- ctctacagcaagctcaccgtggacaagagcaggtggcagcaggggaacgtct- tctcatgctccgtgatgcatgaggctctgcacaaccactacacgcagaagagc- ctctccctgtctccgggtaaa (SEQ ID NO: 331).

In another embodiment of the invention, the polynucleotides of the invention comprise, or alternatively consist of, the following polynucleotide sequence encoding the variable heavy chain polypeptide sequence of SEQ ID NO: 322: cagtcggtggaggagtccggggtcgcctggtcacgcctgggacacccctgac- actcacctgcacagtgtctggaatcgacctc aatagcaatggaatgagctggtc- cgccaggctccagggagggggctggaatggatcggagccagtagtatt- gatgggaccac atactacaccaattgggcgaagggccgattcaccatctc- caaaacctcgtcgaccacggtggatctgaaaatcaccagtccgacaaccgag- gacacggccaccctatttctgtaccagaggggagtatgctggtgttgttggttc- gaactactttgacttgtggggccagggca ccctcgtcaccgtctcgagc (SEQ ID NO: 332).

In another embodiment of the invention, polynucleotides of the invention comprise, or alternatively consist of, the following polynucleotide sequence encoding the constant heavy chain polypeptide sequence of SEQ ID NO: 330: gcctccaccaagggcccatcggtcttccccctggcaccctcctccaagagcacct- ctgggggcacagcggccctgggctgcctg gtcaaggactactlccccgaaccg- gtgacggtgtcgtggaactcaggcgccctgaccagcggcgtgcacaccttccg- gctgtcc tacagtcctcaggactctactccctcagcagcgtggtgaccgtgccc- tccagcagcttgggcacccagacctacatctgcaacgtg aatcacaagcccag- caacac caaggtggacaagagagttgagcccaaatcttgtgacaaaactcaca- catgcccaccgtgccca gcacctgaactcctgggggaccgtcagtcttcctct- tcccccaaaacccaaggacaccctcatgatctcccggacccctgaggtcacat- gcgtggtggtggacgtgagccacgaagaccctgaggtcaagttcaactg- gtacgtggacgcgtggaggtgcataatgc caagacaaagccgcgggaggag- cagtacgccagcacgtaccgtgtggtcagcgtcctcaccgtcctgcacca- ggactggctga atggcaaggagtacaagtgcaaggtctccaacaaagccctcc- cagcccccatcgagaaaaccatctccaaagccaaagggcag ccccgagaac- cacaggtgtacaccctgcccccatcccgggaggagatgaccaagaacca- ggtcagcctgacctgcctggtcaa aggcttctatcccagcgacatcgccgtgg- agtgggagagcaatgggcagccgggagaacaactacaagaccacgcctcccgt- gct ggactccgacggctccttcttcctctacagcaagctcaccgtggacaaga- gcaggtggcagcaggggaacgtcttctcatgctccg tgatgcatgaggctctg- cacaaccactacacgcagaagagcctctccctgtctccgggtaaa (SEQ ID NO: 340).

In another embodiment of the invention, polynucleotides of the invention comprise, or alternatively consist of, the following polynucleotide sequence encoding the light chain polypeptide sequence of SEQ ID NO: 341: caagtgctgaccca- gactccaccctccgtgtctgcagttgtgggaggcacagtca ccatcaattgcca- gtccagtcagaggatttat agtaattggttatcttggtatcagcagaaacca- gggcaga ctcccaagcccctgatctatgctgcatccagcctggcatctgggtc- ccatcgcggttcaaaggcagtggatctgggacacagttcactctcaccatcagcg- acctggagtgtgacgatgctgccagttacta ctgtgcaggctattatagtggtcat- atttattctttcg gcggagggaccgaggtggtggtcaaacgtacggtagcggc- cccatctgtc ttcatcttcccgccatctgatgagcagttgaaatctggaactgcctct- gttgtgtg cctgctgaataacttctatcccagagaggccaaa- gtacagtggaaggtggataacgccctccaatcgggtaactcccaggag agtgt- cacagagcaggacagcaaggacagcaccta cagcctcagcagcaccct- gacgctgagcaaagcagacta cgagaaacacaaagtctacgcctgcgaagt- cacccatcagggcct gagctcgcccgtcacaaagagcttcaacaggggagagtgt (SEQ ID NO: 351).

In another embodiment of the invention, polynucleotides of the invention comprise, or alternatively consist of, the following polynucleotide sequence encoding the variable light chain polypeptide sequence of SEQ ID NO: 342: caagtgctgacccagactccaccctccgtgtctgcagttgtgggaggcacagtca- ccatcaattgccagtccagtcagaggatttat agtaattggttatcttggtatcagca- gaaaccagggcagactcccaagcccctgatctatgctgcatccagcctg- gcatctggggtc ccatcgcggttcaaaggcagtggatctgggacacagttcactc- tcaccatcagcgacctggagtgtgacgatgctgccagttacta ctgtgcaggctat- tatagtggtcatatttattctttcggcggagggaccgaggtggtggtcaaacgt- (SEQ ID NO: 352).

In another embodiment of the invention, polynucleotides of the invention comprise, or alternatively consist of, the following polynucleotide sequence encoding the constant light chain polypeptide sequence of SEQ ID NO: 350: acggtagcggccccatctgtatcatcttcccgccatctgatgagcagttgaaatctg- gaactgcctctgttgtgtgcctgctgaataa cactatcccagagaggccaaagta- cagtggaaggtggataacgccaccaatcgggtaactcccaggagagtgtcaca- gagca ggacagcaaggacagcaccctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 360).

In a further embodiment of the invention, polynucleotides encoding antibody fragments having binding specificity to HGF comprise, or alternatively consist of, one or more of the polynucleotide sequences of SEQ ID NO: 334; SEQ ID NO: 336; and SEQ ID NO: 338, which correspond to polynucleotides encoding the complementarity-determining regions (CDRs, or hypervariable regions) of the heavy chain sequence of SEQ ID NO: 321 or the variable heavy chain sequence of SEQ ID NO: 322, and/or one or more of the polynucleotide sequences of SEQ ID NO: 354; SEQ ID NO: 356; and SEQ ID NO: 358, which correspond to the complementarity-determining regions (CDRs, or hypervariable regions) of the light chain sequence of SEQ ID NO: 341 or the variable light chain sequence of SEQ ID NO: 342, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 333; SEQ ID NO: 335; SEQ ID NO: 337; and SEQ ID NO: 339, which correspond to polynucleotides encoding the framework regions (FRs or constant regions) of the heavy chain sequence of SEQ ID NO: 321 or the variable heavy chain sequence of SEQ ID NO: 322, and/or one or more of the polynucleotide sequences of SEQ ID NO: 353; SEQ ID NO: 355; SEQ ID NO: 357; and SEQ ID NO: 359, which correspond to the framework regions (FRs or constant regions) of the light chain sequence of SEQ ID NO: 341 or the variable light chain sequence of SEQ ID NO: 342, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 331 encoding the heavy chain sequence of SEQ ID NO: 321; the polynucleotide SEQ ID NO: 332 encoding the variable heavy chain sequence of SEQ ID NO: 322; the polynucleotide SEQ ID NO: 351 encoding the light chain sequence of SEQ ID NO: 341; the polynucleotide SEQ ID NO: 352 encoding the variable light chain sequence of SEQ ID NO: 342; polynucleotides encoding the complementarity-determining regions (SEQ ID NO: 334; SEQ ID NO: 336; and SEQ ID NO: 338) of the heavy chain sequence of SEQ ID NO: 321 or the variable heavy chain sequence of SEQ ID NO: 322; polynucleotides encoding the complementarity-determining regions (SEQ ID NO: 354; SEQ ID NO: 356; and SEQ ID NO: 358) of the light chain sequence of SEQ ID NO: 341 or the variable light chain sequence of SEQ ID NO: 342; polynucleotides encoding the framework regions (SEQ ID NO: 333; SEQ ID NO: 335; SEQ ID NO: 337; and SEQ ID NO: 339) of the heavy chain sequence of SEQ ID NO: 321 or the variable heavy chain sequence of SEQ ID NO: 322; and polynucleotides encoding the framework regions (SEQ ID NO: 353; SEQ ID NO: 355; SEQ ID NO: 357; and SEQ ID NO: 359) of the light chain sequence of SEQ ID NO: 341 or the variable light chain sequence of SEQ ID NO: 342.

In a preferred embodiment of the invention, polynucleotides of the invention comprise, or alternatively consist of, polynucleotides encoding Fab (fragment antigen binding) fragments having binding specificity for HGF. With respect to antibody Ab9, the polynucleotides encoding the full length Ab9 antibody comprise, or alternatively consist of, the polynucleotide SEQ ID NO: 331 encoding the heavy chain sequence of SEQ ID NO: 321 and the polynucleotide SEQ ID NO: 351 encoding the light chain sequence of SEQ ID NO: 341.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab9 following expression of the full-length polynucleotides in a suitable host. In another embodiment of the invention, anti-HGF antibodies such as Ab9 or Fab fragments thereof may be produced via expression of Ab9 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab10

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 361: gaggtgcagctggtggagtctggggggaggcttggtccagcctgggggtccctgagactctcctgtgcagcctctggattcaccg tcagtagcaatggaatgagctgggtccgtcaggctccagggaaggggctggagtgggtcggagccagtagtattgatgggacca catactacaccaattctgcgaagggccgattcaccatctccagagacaattccaagaacaccctgtatcttcaaatgaacagcctgagagctgaggacactgctgtgtattactgtgctagaggggagtatgctggtgttgaggttcgaactactttgacttgtggggccaagg gaccctcgtcaccgtctcgagcgcctccaccaagggcccatcggtcttccccctggcaccctcctccaagagcacctctggggc acagcggccctgggctgcctggtcaaggactacttcccgaaccggtgacggtgtcgtggaactcaggcgccctgaccagcggc gtgcaccttcccggctgtcctacagtcctcaggactctactccctcagcagcgtggtgaccgtgccctccagcagcttgggcac ccagacctacatctgcaacgtgaatcacaagcccagcaacaccaaggtggacaagagagttgagcccaaatcttgtgacaaaact cacacatgcccaccgtgcccagcacctgaactcctgggggga ccgtcagtcttcctcttcccccaaaacccaaggacaccctcatgatctcccggacccctgaggtcacatgcgtggtggtggacgtgagccacgaagaccctgaggtcaagttcaactggtacgtggac ggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagcccctcccagcccccatcgagaaaaccat ctccaaagccaaagggcagccccgagaaccacaggtgtacaccctgcccccatcccgggaggagatgaccaagaaccaggtc agcctgacctgcctggtcaaaggcttctatcccagcgacatcgccgtggagtgggagagcaatgggcagccggagaacaactac aagaccacgcctcccgtgctggactccgacggctccttcttcctctacagcaagctcac-
cgtggacaagagcaggtggcagcagg ggaacgtcttctcatgctccgtgatg-
catgaggctctgcacaaccactacacgcagaagagcctctccctgtctccggg-
taaa (SEQ ID NO: 371).

In another embodiment of the invention, the polynucleotides of the invention comprise, or alternatively consist of, the following polynucleotide sequence encoding the variable heavy chain polypeptide sequence of SEQ ID NO: 362:
gaggtgcagctggtggagtctgggggaggcttggtccagcctggggggtccct-
gagactctcctgtgcagcctctggattcaccgtcagtagcaatggaat-
gagctgggtccgtcaggctccagggaaggggctggagtgggtcggagccag-
tagtattgatgggacca catactacaccaattctgcgaagggccgattcac-
catctccagagacaattccaagaacaccctgtatcttcaaatgaacagcctga-
gagctgaggacactgctgtgtattactgtgctagaggggagtatgctggtgttgt-
tggttcgaactactagacttgtggggccaagg gaccctcgtcaccgtctcgagc
(SEQ ID NO: 372).

In another embodiment of the invention, polynucleotides of the invention comprise, or alternatively consist of, the following polynucleotide sequence encoding the constant heavy chain polypeptide sequence of SEQ ID NO: 370:
gcctccaccaagggcccatcggtcttcccctggcaccctcctccaagagcacc-
tctggggcacagcggccctgggctgcctg gtcaaggactacttccccgaac-
cggtgacggtgtcgtggaactcaggcgccctgaccagcggcgtgcacaccttc-
ccggctgtcc tacagtcctcaggactctactccctcagcagcgtggtgaccgtgc-
cctccagcagcttgggcacccagacctacatctgcaacgtg aatcacaagccca-
gcaacaccaaggtggacaagagagttgagcccaaatcttgtgacaaaactca-
cacatgcccaccgtgccca gcacctgaactcctggggggaccgtcagtcttc-
ctcttcccccaaaacccaaggacaccctcatgatctcccggacccctgaggt-
cacatgcgtggtggtggacgtgagccacgaagaccctgaggtcaagttcaact-
ggtacgtggacggcgtggaggtgcataatgc caagacaaagccgcgggag-
gagcagtacgccagcacgtaccgtgtggtcagcgtcctcaccgtcctgcacca-
ggactggctga atggcaaggagtacaagtgcaaggtctccaacaaagccctcc-
cagccccatcgagaaaaccatctccaaagccaaagggcag ccccgagaac-
cac aggtgtacaccctgcccccatcccgggaggagatgaccaagaacca-
ggtcagcctgacctgcctggtcaa aggcttctatcccagcgacatcgccgtg-
gagtgggagagcaatgggcagccggagaacaactacaagaccacgcctcccgt-
gct ggactccgacggctccttcttcctctacagcaagctcaccgtggacaagag-
caggtggcagcaggggaacgtcttctcatgctccg tgatgcatgaggctctgca-
caaccactacacgcagaagagcctctccctgtctccgggtaaa (SEQ ID NO: 380).

In another embodiment of the invention, polynucleotides of the invention comprise, or alternatively consist of, the following polynucleotide sequence encoding the light chain polypeptide sequence of SEQ ID NO: 381: gacatccagatgac-
ccagtctccatcttccgtgtctgcatctgtaggagacagagtcaccatcactt-
gtcagtccagtcagaggatct atagtaattggttatcttggtatcagcagaaaccag-
ggaaagcccctaagctcctgatctatgctgcatccagcctggcatctggggt-
cccatcaaggttcagcggcagtggatctgggacagatttcactctcaccatcagc-
agcctgcagcctgaagattttgcaacttactat tgtgcaggctactatagtggt-
catatctattattcggcggaggaaccaaggtggaaatcaaacgtacggtagcg-
gccccatctgtct tcatcttcccgccatctgatgagcagttgaaatctggaact-
gcctctgttgtgtgcctgctgaataacttctatcccagagaggccaaagtaca-
gtggaaggtggataacgccctccaatcgggtaactcccaggagagtgtcaca-
gagcaggacagcaaggacagcaccta cagcctcagcagcaccctgacgct-
gagcaaagcagactacgagaaacacaaagtctacgcctgcgaagtcac-
ccatcagggcct gagctcgcccgtcacaaagagcttcaacaggggagagtgt
(SEQ ID NO: 391).

In another embodiment of the invention, polynucleotides of the invention comprise, or alternatively consist of, the following polynucleotide sequence encoding the variable light chain polypeptide sequence of SEQ ID NO: 382:
gacatccagatgacccagtctccatatccgtgtctgcatctgtaggagacagagt-
caccatcacttgtcagtccagtcagaggatct atagtaattggttatcaggtatca-
gcagaaaccagggaaagcccctaagctcctgatctatgctgcatccagcctg-
gcatctggggt cccatcaaggttcagcggcagtggatctgggacagatttca-
ctctcaccatcagcagcctgcagcctgaagattttgcaacttactattgtgcaggc-
tactatagtggtcatatctattatcatcggcggaggaaccaaggtggaaatcaaacgt-
(SEQ ID NO: 392).

In another embodiment of the invention, polynucleotides of the invention comprise, or alternatively consist of, the following polynucleotide sequence encoding the constant light chain polypeptide sequence of SEQ ID NO: 390:
acggtagcggccccatctgtcttcatcttcccgccatctgatgagcagttgaaatc-
tggaactgcctctgttgtgtgcctgctgaataa cttctatcccagagaggccaaag-
tacagtggaaggtggataacgccctccaatcgggtaactcccaggagagtgt-
cacagagca ggacagcaaggacagcacctacagcctcagcagcaccctgacg-
ctgagcaaagcagactacgagaaacacaaagtctacgcct gcgaagtcac-
ccatcagggcctgagctcgcccgtcacaaagagcttcaacaggggagagtgt
(SEQ ID NO: 400).

In a further embodiment of the invention, polynucleotides encoding antibody fragments having binding specificity to HGF comprise, or alternatively consist of, one or more of the polynucleotide sequences of SEQ ID NO: 374; SEQ ID NO: 376; and SEQ ID NO: 378, which correspond to polynucleotides encoding the complementarity-determining regions (CDRs, or hypervariable regions) of the heavy chain sequence of SEQ ID NO: 361 or the variable heavy chain sequence of SEQ ID NO: 362, and/or one or more of the polynucleotide sequences of SEQ ID NO: 394; SEQ ID NO: 396; and SEQ ID NO: 398, which correspond to the complementarity-determining regions (CDRs, or hypervariable regions) of the light chain sequence of SEQ ID NO: 381 or the variable light chain sequence of SEQ ID NO: 382, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 373; SEQ ID NO: 375; SEQ ID NO: 377; and SEQ ID NO: 379, which correspond to polynucleotides encoding the framework regions (FRs or constant regions) of the heavy chain sequence of SEQ ID NO: 361 or the variable heavy chain sequence of SEQ ID NO: 362, and/or one or more of the polynucleotide sequences of SEQ ID NO: 393; SEQ ID NO: 395; SEQ ID NO: 397; and SEQ ID NO: 399, which correspond to the framework regions (FRs or constant regions) of the light chain sequence of SEQ ID NO: 381 or the variable light chain sequence of SEQ ID NO: 382, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 371 encoding the heavy chain sequence of SEQ ID NO: 361; the polynucleotide SEQ ID NO: 372 encoding the variable heavy chain sequence of SEQ ID NO: 362; the polynucleotide SEQ ID NO: 391 encoding the light chain sequence of SEQ ID NO: 381; the polynucleotide SEQ ID NO: 392 encoding the variable light chain sequence of SEQ ID NO: 382; polynucleotides encoding the complementarity-determining regions (SEQ ID NO: 374; SEQ ID NO: 376; and SEQ ID NO: 378) of the heavy chain sequence of SEQ ID NO: 361 or the variable heavy chain sequence of SEQ ID NO: 362; polynucleotides encoding the complementarity-determining regions (SEQ ID NO: 394; SEQ ID NO: 396; and SEQ ID NO: 398) of the light chain sequence of SEQ ID NO: 381 or the variable light chain sequence of SEQ ID NO: 382; polynucleotides encoding the framework regions (SEQ ID NO: 373; SEQ ID NO: 375; SEQ ID NO: 377; and SEQ ID NO: 379) of the heavy chain sequence of SEQ ID NO: 361 or the variable heavy chain sequence of SEQ ID NO: 362; and polynucleotides encoding the framework regions (SEQ ID NO: 393; SEQ ID NO: 395; SEQ ID NO: 397; and SEQ ID NO: 399) of the light chain sequence of SEQ ID NO: 381 or the variable light chain sequence of SEQ ID NO: 382.

In a preferred embodiment of the invention, polynucleotides of the invention comprise, or alternatively consist of, polynucleotides encoding Fab (fragment antigen binding) fragments having binding specificity for HGF. With respect to antibody Ab10, the polynucleotides encoding the full length Ab10 antibody comprise, or alternatively consist of, the polynucleotide SEQ ID NO: 371 encoding the heavy chain sequence of SEQ ID NO: 361 and the polynucleotide SEQ ID NO: 391 encoding the light chain sequence of SEQ ID NO: 381.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab10 following expression of the full-length polynucleotides in a suitable host. In another embodiment of the invention, anti-HGF antibodies such as Ab10 or Fab fragments thereof may be produced via expression of Ab10 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab11

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 401: cagtcaatggaggagtccggggtcgcctggtcacgcctggga- cacccctgacactcacctgcacagtctctggattctccctcag tgactatgcg- ttgagctgggtccgccaggctccagggaaggggctggaatggatcggaatgatt- agtagtggtgacaacacatact acgcgagctgggcgaaaggccgattcac- catctccaaagcctcgaccacggtggatctgaaaatcaccagtccgacaac- cgagg acacggccacctatttctgtgccagagataaagatgctagtagtggt- ggttatttggtccttgacctattggatgtccccgacggcatg gacctctgggc- ccaggcaccctcgtcaccgtctcgagcgcctccaccaagggcccatcggtcttc- cccctggcacccctcctcca agagcacctctgggggcacagcggccctgggct- gcctggtcaaggactacttccccgaaccggtgacggtgtcgtggaactcag- gcgccctgaccagcggcgtgcacaccttccggctgtcctacagtcctcaggact- ctactcccctcagcagcgtggtgaccgtgcc ctccagcagcttgggcacccagacctacatctgcaacgtgaatcacaagcccagcaacaccaaggtggacaagagagt- tgagcc caaatcttgtgacaaaactcacacatgcccaccgtgcccagcacct- gaactcctgggggaccgtcagtcttcctcttccccccaaa acccaaggacac- cctcatgatctcccggacccctgaggtcacatgcgtggtggtggacgtgagcc- acgaagaccctgaggtcaa gttcaactggtacgtggacggcgtggaggtg- cataatgccaagacaaagccgcgggaggagcagtacgccagcacgtaccgtg- tggtcagcgtcctcaccgtcctgcaccaggactggctgaatggcaaggagtaca- agtgcaaggtctccaacaaagccctcccagc ccccatcgagaaaaccatc- ccaaagccaaagggcagccccgagaaccacaggtgtacaccctgcccccatc- ccgggaggag atgaccaagaaccaggtcagcctgacctgcctggtcaa- aggcttctatcccagcgacatcgccgtggagtgggagagcaatggg cagccg- gagaacaactacaagaccacgcctcccgtgctggactccgacggctccttcttc- ctctacagcaagctcaccgtggaca agagcaggtggcagcaggggaacgtct- tctcatgaccgtgatgcatgaggctctgcacaaccactacacgcagaagagc- ctctc cctgtctccgggtaaa (SEQ ID NO: 411).

In another embodiment of the invention, the polynucleotides of the invention comprise, or alternatively consist of, the following polynucleotide sequence encoding the variable heavy chain polypeptide sequence of SEQ ID NO: 402: cagtcaatggaggagtccggggtcgcctggtcacgcctgggacaccccctga- cactcacctgcacagtctctggattctccctcag tgactatgcgttgagctgggtc- cgccaggctccagggaaggggctggaatggatcggaatgattagtagtggt- gacaacacatact acgcgagagggcgaaaggccgattcaccataccaaagcct- cgaccacggtggatctgaaaatcaccagtccgacaaccgagg acacggc- cacct atttctgtgccagagataaagatgctagtagtggtggttatttggtcctt- gacctattggatgtccccgacggcatg gacctctggggcccaggcaccctcgt- caccgtacgagc (SEQ ID NO: 412).

In another embodiment of the invention, polynucleotides of the invention comprise, or alternatively consist of, the following polynucleotide sequence encoding the constant heavy chain polypeptide sequence of SEQ ID NO: 410: gcctccaccaagggcccatcggtcttcccccctggcacccctcctccaagagcacct- ctgggggcacagcggccctgggctgcctg gtcaaggactacttccccgaaccg- gtgacggtgtcgtggaactcaggcgccctgaccagcggcgtgcacaccttcccg- gctgtcc tacagtcctcaggactctactcccctcagcagcgtggtgaccgtgc- cctccagcagcttgggcacccagacctacatctgcaacgtg aatcacaagc- ccagcaacaccaaggtggacaagagagttgagcccaaatcttgtgacaaaac- tcacacatgcccaccgtgccca gcacctgaactcctgggggaccgtcagtct- tcctcttccccccaaaacccaaggacacccctcatgatctcccggacccctgaggt- cacatgcgtggtggtggacgtgagccacgaagaccctgaggtcaagttcaactg- gtacgtggacggcgtggaggtgcataatgc caagacaaagccgcgggaggag- cagtacgccagcacgtaccgtgtggtcagcgtcctcaccgtcctgcaccag- gactggctga atggcaaggagtacaagtgcaaggtctccaacaaagccctccc- agccccccatcgagaaaaccatctccaaaggccaaagggcag ccccgagaacca- caggtgtacaccctgcccccatcccgggaggagatgaccaagaaccaggtcag- cctgacctgcctggtcaa aggcttctatcccagcgacatcgccgtggagtggga- gagcaatgggcagccggagaacaactacaagaccacgcctcccgtgct- ggactccgacggctccttcttcctctacagcaagctcaccgtggacaagagcag- gtggcagcaggggaacgtcttctcatgctccg tgatgcatgaggctctgcacaac- cactacacgcagaagagcctctccctgtctccgggtaaa (SEQ ID NO: 420).

In another embodiment of the invention, polynucleotides of the invention comprise, or alternatively consist of, the following polynucleotide sequence encoding the light chain polypeptide sequence of SEQ ID NO: 421: gccgtgctgaccca- gacaccatcgcccgtgtctgcagctgtgggaggcacagtcaccatcaagtgc- cagtccagtcagagtgttta taataacaacctcttatcctggtatcagcagaaac- cagggcagcctcccaagctcctgatctggggtgcatcctatctgccatctggg- gtcccagataggttcagcggcagtggatctgggacacagttcactctcaccatca- gcggcgtgcagtgtgacgatgctgccactta ctactgtctaggcggttatgatg- gtgatgctgatacatataatactttcggcggagggaccgaggtggtggtcaaac- gtacggtagc ggccccatctgtcttcatcttcccgccatctgatgagcagttgaa- atctggaactgcctctgttgtgtgcctgctgaataacttctatccc agagaggcca- agtacagtggaaggtggataacgccctccaatcgggtaactcccaggagagt- gtcacagagcaggacagcaa ggacagcacctacagcctcagcagcaccct-gacgctg agcaaagcagactacgagaaacacaaagtctacgcctgcgaag- tca cccatcagggcctgagctcgcccgtcacaaagagcttcaacaggggagagtgt (SEQ ID NO: 431).

In another embodiment of the invention, polynucleotides of the invention comprise, or alternatively consist of, the following polynucleotide sequence encoding the variable light chain polypeptide sequence of SEQ ID NO: 422: gccgtgctgacccagacaccatcgcccgtgtctgcagagtgggaggcacagtc- accatcaagtgccagtccagtcagagtgttta taataacaacctcttatcctgg- tatcagcagaaaccagggcagcctcccaagacctgatctggggtgcatc- ctatctgccatctggggtcccagataggttcagcggcagtggatctgggacaca- gttcactctcaccatcagcggcgtgcagtgtgacgatgctgccacttactact- gtctaggcggttatgatggtgatgctgatacatataatactttcggcggagggac- cgaggtggtggtcaaacgt (SEQ ID NO: 432).

In another embodiment of the invention, polynucleotides of the invention comprise, or alternatively consist of, the following polynucleotide sequence encoding the constant light chain polypeptide sequence of SEQ ID NO: 430: acggtagcggccccatctgtcttcatcttcccgccatctgatgagcagttgaaatct- ggaactgcctctgttgtgtgcctgctgaataacactatcccagagaggccaaag- tacagtggaaggtggataacgccctccaatcgggtaactcccaggagagtgt- cacagagca ggacagcaaggacagcacctacagcctcagcagcaccctga- cgctgagcaaagcagactacgagaaacacaaagtctacgcct gcgaagtcac- ccatcagggcctgagctcgcccgtcacaaagagcttcaacaggggagagtgt (SEQ ID NO: 440).

In a further embodiment of the invention, polynucleotides encoding antibody fragments having binding specificity to HGF comprise, or alternatively consist of, one or more of the polynucleotide sequences of SEQ ID NO: 414; SEQ ID NO: 416; and SEQ ID NO: 418, which correspond to polynucleotides encoding the complementarity-determining regions (CDRs, or hypervariable regions) of the heavy chain sequence of SEQ ID NO: 401 or the variable heavy chain sequence of SEQ ID NO: 402, and/or one or more of the polynucleotide sequences of SEQ ID NO: 434; SEQ ID NO: 436; and SEQ ID NO: 438, which correspond to the complementarity-determining regions (CDRs, or hypervariable regions) of the light chain sequence of SEQ ID NO: 421 or the variable light chain sequence of SEQ ID NO: 422, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 413; SEQ ID NO: 415; SEQ ID NO: 417; and SEQ ID NO: 419, which correspond to polynucleotides encoding the framework regions (FRs or constant regions) of the heavy chain sequence of SEQ ID NO: 401 or the variable heavy chain sequence of SEQ ID NO: 402, and/or one or more of the polynucleotide sequences of SEQ ID NO: 433; SEQ ID NO: 435; SEQ ID NO: 437; and SEQ ID NO: 439, which correspond to the framework regions (FRs or constant regions) of the light chain sequence of SEQ ID NO: 421 or the variable light chain sequence of SEQ ID NO: 422, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 411 encoding the heavy chain sequence of SEQ ID NO: 401; the polynucleotide SEQ ID NO: 412 encoding the variable heavy chain sequence of SEQ ID NO: 402; the polynucleotide SEQ ID NO: 431 encoding the light chain sequence of SEQ ID NO: 421; the polynucleotide SEQ ID NO: 432 encoding the variable light chain sequence of SEQ ID NO: 422; polynucleotides encoding the complementarity-determining regions (SEQ ID NO: 414; SEQ ID NO: 416; and SEQ ID NO: 418) of the heavy chain sequence of SEQ ID NO: 401 or the variable heavy chain sequence of SEQ ID NO: 402; polynucleotides encoding the complementarity-determining regions (SEQ ID NO: 434; SEQ ID NO: 436; and SEQ ID NO: 438) of the light chain sequence of SEQ ID NO: 421 or the variable light chain sequence of SEQ ID NO: 422; polynucleotides encoding the framework regions (SEQ ID NO: 413; SEQ ID NO: 415; SEQ ID NO: 417; and SEQ ID NO: 419) of the heavy chain sequence of SEQ ID NO: 401 or the variable heavy chain sequence of SEQ ID NO: 402; and polynucleotides encoding the framework regions (SEQ ID NO: 433; SEQ ID NO: 435; SEQ ID NO: 437; and SEQ ID NO: 439) of the light chain sequence of SEQ ID NO: 421 or the variable light chain sequence of SEQ ID NO: 422.

In a preferred embodiment of the invention, polynucleotides of the invention comprise, or alternatively consist of, polynucleotides encoding Fab (fragment antigen binding) fragments having binding specificity for HGF. With respect to antibody Ab11, the polynucleotides encoding the full length Ab11 antibody comprise, or alternatively consist of, the polynucleotide SEQ ID NO: 411 encoding the heavy chain sequence of SEQ ID NO: 401 and the polynucleotide SEQ ID NO: 431 encoding the light chain sequence of SEQ ID NO: 421.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab11 following expression of the full-length polynucleotides in a suitable host. In another embodiment of the invention, anti-HGF antibodies such as Ab11 or Fab fragments thereof may be produced via expression of Ab11 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab12

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 441: cagtcgctggaggagtccgggggtcgcctggtaacgcctggaggatccctgacactcacctgcacagtctctggaatcgacctca gtagcaatgcaataagctgggtccgccaggctccagagaaggggctggagtggatcgcagtcatttatgttgttggtgccactgac tacgcgagagggcgaaaggccgattcaccatac-cagaacctcgaccacggtggatctgaaaatgaccagtctgacaaccgag-gacacggccacctatttctgtgccagagtttatgattctggctggaatcacttt-aacttgtggggcccaggcaccctcgtcaccgtctc gagcgcctccac-caagggcc catcggtcttccccctggcaccctcctccaagagcacctctggggggcacagcggccctgggctg cctggtcaaggactacttccccgaaccggt0gacggtgtcgtggaactcaggcgccctgaccagcggcgtgcacaccacccg-gct gtcctacagtcctcaggactctactccctcagcagcgtggtgaccgtgc-cctccagcagcttgggcacccagacctacatctgcaa cgtgaatcacaag-cccagcaacaccaaggtggacaagagagttgagcccaaatcttgtgacaaaact-cacacatgcccaccgtg cccagcacctgaactcctgggggggaccgtcagtcttc-ctcttccccccaaaacccaaggacaccctcatgatctcccggaccctg aggtc-acatgcgtggtggtggacgtgagccacgaagaccctgaggtcaagttcaactg-gtacgtggacggcgtggaggtgcata atgccaagacaaagccgcgggag-gagcagtacgccagcacgtaccgtgtggtcagcgtcctcaccgtcctgcaccag-gactgg ctgaatggcaaggagtacaagtgcaaggtctccaacaaagccctc-ccagcccccatcgagaaaaccatctccaaagccaaaggg cagccccgaaac-cacaggtgtacaccctgcccccatcccggaggagatgaccaagaaccagg-tcagcctgacctgcctggt caaaggcttctatcccagcgacatcgccgtg-gagtgggagagcaatgggcagccggagaacaactacaagaccacgcctccg-tgctggactccgacggctccttcttcctctacagcaagctcaccgtggacaaga-gcaggtggcagcaggggaacgtcttctcatgc tccgtgatgcatgaggactgca- caaccactacacgcagaagagcctctccctgtctccgggtaaa (SEQ ID NO: 451).

In another embodiment of the invention, the polynucleotides of the invention comprise, or alternatively consist of, the following polynucleotide sequence encoding the variable heavy chain polypeptide sequence of SEQ ID NO: 442: cagtcgctggaggagtccgggggtcgcctggtaacgcctggaggatccctga-cactcacctgcacagtctctggaatcgacctca gtagcaatgcaataagctggg-tccgccaggctccagagaaggggctggagtggatcgcagtcatttatgttgttg-gtgccactgac tacgcgagagggcgaaaggccgattcaccataccagaacctc-gaccacggtggatctgaaaatgaccagtctgacaaccgag gacacggccac-ctatttctgtgccagagtttatgattctggctggaatcactttaacttgtggggccca-ggcaccctcgtcaccgtctc gage (SEQ ID NO: 452).

In another embodiment of the invention, polynucleotides of the invention comprise, or alternatively consist of, the following polynucleotide sequence encoding the constant heavy chain polypeptide sequence of SEQ ID NO: 450: gcctccaccaagggcccatcggtcttccccctggcaccctcctccaagagcacct-ctgggggcacagcggccctgggctgcctg gtcaaggactacttccccgaaccg-gtgacggtgtcgtggaactcaggcgccctgaccagcggcgtgcacaccttc-ccggctgtcc tacagtcctcaggactctactccctcagcagcgtggtgaccgt-gcctccagcagcttgggcacccagacctacatctgcaacgtg aatcacaagc-ccagcaacaccaaggtggacaagagagttgagcccaaatcttgtgacaaaac-tcacacatgcccaccgtgccca gcacctgaactcctgggggggaccgtcagtct-tcctcttccccccaaaacccaaggacaccctcatgatctcccggaccctgaggt-cacatgcgtggtggtggacgtgagccacgaagaccctgaggtcaagttcaactg-gtacgtggacggcgtggaggtgcataatgc caagacaaagccgcgggaggag-cagtacgccagcacgtaccgtgtggtcagcgtcctcaccgtcctgcaccag-gactgctga atgcaaggagtacaagtgcaaggtaccaacaaagccctc-ccagcccccatcgagaaaaccatctccaaagccaaagggcag ccccga-gaaccacaggtgtacaccctgcccccatcccggaggagatgaccaagaacc-aggtcagcctgacctgcctggtcaa aggcttctatcccagcgacatcgccgtg-gagtgggagagcaatgggcagccggagaacaactacaagaccacgcctc-ccgtgct ggactccgacggctccttcttcctctacagcaagctcaccgtggacaa-gagcaggtggcagcaggggaacgtcttctcatgctccg tgatgcatgaggctct-gcacaaccactacacgcagaagagcctctccctgtctccgggtaaa (SEQ ID NO: 460).

In another embodiment of the invention, polynucleotides of the invention comprise, or alternatively consist of, the following polynucleotide sequence encoding the light chain polypeptide sequence of SEQ ID NO: 461: gcctatgatatg-acccagactccagcctctgtggaggtagagtgggaggcacagtcaccatcaa-gtgccaggtcagtcagagca ttagtagaggttatcctggtatcagaagaaacca-gggcagcgtcccaagctcctgatctacagggcatccactctggcatctgggg-tacatcgcggttcaaaggcagtggatctgggacagagttcactctcaccatcag-cggccgtggagtgtgccgatgctgccacttact actgtcaacaggcttatagtgt-tagtaatgttgataatgattcggcggagggaccgaggtggtggtcaaacgtacg-gtagcggccc catctgtcttcatcttcccgccatctgatgagcagttgaaatctgga-actgcctctgagtgtgcctgctgaataacttctatcccagaga ggccaaagtaca-gtggaaggtggataacgccctccaatcgggtaactcccaggagagtgtcaca-gagcaggacagcaaggaca gcacctacagcctcagcagcaccctgacgctga-gcaaagcagactacgagaaacacaaagtctacgcctgcgaagtcacccatc-agggcctgagctcgcccgtcacaaagagcttcaacaggggagagtgt (SEQ ID NO: 471).

In another embodiment of the invention, polynucleotides of the invention comprise, or alternatively consist of, the following polynucleotide sequence encoding the variable light chain polypeptide sequence of SEQ ID NO: 462: gcctatgatatgacccagactccagcctctgtggaggtagctgtgggaggcacag-tcaccatcaagtgccaggtcagtcagagca ttagtagttggttatcctggtatca-gaagaaaccagggcagcgtcccaagctcctgatctacagggcatccactctg-gcatctgggg tctcatcgcggttcaaaggcagtggatctgggacagagttca-ctctcaccatcagcggcgtggagtgtgccgatgctgccacttact actgtcaac-aggcttatagtgttagtaatgttgataatgctttcggcggagggaccgaggtggt-ggtcaaacgt (SEQ ID NO: 472).

In another embodiment of the invention, polynucleotides of the invention comprise, or alternatively consist of, the following polynucleotide sequence encoding the constant light chain polypeptide sequence of SEQ ID NO: 470: acggtagcggcccccatctgtatcatcttcccgccatctgatgagcagttgaaatct-ggaactgcctctgttgtgtgcctgctgaataa cactatcccagagaggccaaag-tacagtggaaggtggataacgccctccaatcgggtaactcccaggagagtgt-cacagagca ggacagcaaggacagcacctacagcctcagcagcaccct-gacgctgagcaaagcagactacgagaaacacaaagtctacgcct gcgaagt-cacccatcagggcctgagctcgcccgtcacaaagagcttcaacaggggagagtgt (SEQ ID NO: 480).

In a further embodiment of the invention, polynucleotides encoding antibody fragments having binding specificity to HGF comprise, or alternatively consist of, one or more of the polynucleotide sequences of SEQ ID NO: 454; SEQ ID NO: 456; and SEQ ID NO: 458, which correspond to polynucleotides encoding the complementarity-determining regions (CDRs, or hypervariable regions) of the heavy chain sequence of SEQ ID NO: 441 or the variable heavy chain sequence of SEQ ID NO: 442, and/or one or more of the polynucleotide sequences of SEQ ID NO: 474; SEQ ID NO: 476; and SEQ ID NO: 478, which correspond to the complementarity-determining regions (CDRs, or hypervariable regions) of the light chain sequence of SEQ ID NO: 461 or the variable light chain sequence of SEQ ID NO: 462, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 453; SEQ ID NO: 455; SEQ ID NO: 457; and SEQ ID NO: 459, which correspond to polynucleotides encoding the framework regions (FRs or constant regions) of the heavy chain sequence of SEQ ID NO: 441 or the variable heavy chain sequence of SEQ ID NO: 442, and/or one or more of the polynucleotide sequences of SEQ ID NO: 473; SEQ ID NO: 475; SEQ ID NO: 477; and SEQ ID NO: 479, which correspond to the framework regions (FRs or constant regions) of the light chain sequence of SEQ ID NO: 461 or the variable light chain sequence of SEQ ID NO: 462, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 451 encoding the heavy chain sequence of SEQ ID NO: 441; the polynucleotide SEQ ID NO: 452 encoding the variable heavy chain sequence of SEQ ID NO: 442; the polynucleotide SEQ ID NO: 471 encoding the light chain sequence of SEQ ID NO: 461; the polynucleotide SEQ ID NO: 472 encoding the variable light chain sequence of SEQ ID NO: 462; polynucleotides encoding the complementarity-determining regions (SEQ ID NO: 454; SEQ ID NO: 456; and SEQ ID NO: 458) of the heavy chain sequence of SEQ ID NO: 441 or the variable heavy chain sequence of SEQ ID NO: 442; polynucleotides encoding the complementarity-determining regions (SEQ ID NO: 474; SEQ ID NO: 476; and SEQ ID NO: 478) of the light chain sequence of SEQ ID NO: 461 or the variable light chain sequence of SEQ ID NO: 462; polynucleotides encoding the framework regions (SEQ ID NO: 453; SEQ ID NO: 455; SEQ ID NO: 457; and SEQ ID NO: 459) of the heavy chain sequence of SEQ ID NO: 441 or the variable heavy chain sequence of SEQ ID NO: 442; and polynucleotides encoding the framework regions (SEQ ID NO: 473; SEQ ID NO: 475; SEQ ID NO: 477; and SEQ ID NO: 479) of the light chain sequence of SEQ ID NO: 461 or the variable light chain sequence of SEQ ID NO: 462.

In a preferred embodiment of the invention, polynucleotides of the invention comprise, or alternatively consist of, polynucleotides encoding Fab (fragment antigen binding) fragments having binding specificity for HGF. With respect to antibody Ab12, the polynucleotides encoding the full length Ab12 antibody comprise, or alternatively consist of, the polynucleotide SEQ ID NO: 451 encoding the heavy chain sequence of SEQ ID NO: 441 and the polynucleotide SEQ ID NO: 471 encoding the light chain sequence of SEQ ID NO: 461.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab12 following expression of the full-length polynucleotides in a suitable host. In another embodiment of the invention, anti-HGF antibodies such as Ab12 or Fab fragments thereof may be produced via expression of Ab12 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab13

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 481: gaggtgcagctggtggagtctggggaggcttggtccagcctggggggtccctgagactacctgtgcagcctctggattcaccg tcagtagcaatgcaataagagggtccgtcaggctccagggaagggctggagtgggtcgcagtcatctatgttgttggtgccact gactacgcgagcagtgcgaaaggccgattcaccatctccagagacaattccaagaacaccctgtatcttcaaatgaacagcctgagagctgaggacactgctgtgtattactgtgctagagtttatgattctggctggaatcactttaacttgtggggccaagggaccctcgtca ccgtctcgagcgcctccaccaagggcccatcggtcttccccctggcaccctcctccaagagcacctctggggg cacagcggccc tgggctgcctggtcaaggactacttccccgaaccggtgacggtgtcgtggaactcaggcgccctgaccagcggcgtgcacacctt cccggctgtcctacagtcctcaggactctactccctcagcagcgtggtgaccgtgccctccagcagcttgggcacccagacctaca tctgcaacgtgaatcacaagcccagcaacaccaaggtggacaagagagttgagcccaaatcttgtgacaaaactcacacatgccc accgtgcccagcacctgaactcctgggggaccgtcagtcttcctcttcccccaaaaccaaggacaccctcatgatctcccgga cccctgaggtcacatgc gtggtggtggacgtgagccacgaagaccctgaggtcaagttcaactggtacgtggacggcgtggaggtgcataatgccaagacaaagccgcggag gagcagtacgccagcacgtaccgtgtggtcagcgtcctcaccgtcctgcaccaggactggctga atggcaaggagtacaagtgcaaggtctccaacaaagccctcccagcccccatcgagaaaaccatctccaaagccaaag gcag ccccgagaaccacaggtgtacaccctgcccccatcccgggaggagatgaccaagaaccaggtcagcctgacctg cctggtcaaaggcttctatcccagcgacatcgccgtggagtgggagagcaatgggcagccggagaacaactacaagaccacgcctc ccgtgctggactccgacggctccttcttcctctacagcaagctcaccgtggacaagagcaggtggcagcaggggaacgtcttc tcatgctccgtgatgcatgaggctctgcacaaccactacacgcagaagagcctctccctgtctccgggtaaa (SEQ ID NO: 491).

In another embodiment of the invention, the polynucleotides of the invention comprise, or alternatively consist of, the following polynucleotide sequence encoding the variable heavy chain polypeptide sequence of SEQ ID NO: 482: gaggtgcagctggtggagtctggggaggcttggtccagcctgggggggtccctgagactctcctgtgcagcctctggattcaccg tcagtagcaatgcaataagctgggtccgtcaggctccagggaagggctggagtgggtcgcagtcatctatgttgttggtgccact gactacgcgagcagtgcgaaaggccgattcaccataccagagacaattccaagaacaccctgtatcttcaaatgaacagcctgag agagaggacactgctgtgtattactgtgctagagatatgattctggctggaatcactttaacttgtggggccaagggaccctcgtca ccgtctcgagc (SEQ ID NO: 492).

In another embodiment of the invention, polynucleotides of the invention comprise, or alternatively consist of, the following polynucleotide sequence encoding the constant heavy chain polypeptide sequence of SEQ ID NO: 490: gcctccaccaagggcccatcggtcttccccctggcaccctcctccaagagcac ctctgggggcacagcggccctgggctgcctg gtcaaggactacttccccgaaccggtgacggtgtcgtggaactcaggcgccctgaccagcggcgtgca caccttcccggctgtcc tacagtcctcaggactctactccctcagcagcgtggtga ccgtgccaccagcagcttgggcacccagacctacatctgcaacgtg aatcacaagcccagcaacaccaaggtggacaagagagttgagcccaaatcttgtgaca aaactcacacatgccaccgtgccca gcacctgaactcctgggggaccgtca gtcttcctcttcccccaaaacccaaggacaccctcatgatctcccggaccccct gaggt cacatgcgtggtggtggacgtgagccacgaagaccctgaggtcaa gttcaactggtacgtggacggcgtggaggtgcataatgc caagacaaagc cgcggg aggagcagtacgccagcacgtaccgtgtggtcagcgtcctcac cgtcctgcaccaggactggctga atggcaaggagtacaagtgcaaggtctc caacaaagccctcccagcccccatcgagaaaaccatctccaaagccaag ggcag ccccgagaaccacaggtgtacaccctgcccccatcccgggaggag atgaccaagaaccaggtcagcctgacctgcctggtcaa aggcttctatccca gcgacatcgccgtggagtgggagagcaatgggcagccggagaacaactacaagaccacgcctcccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 500).

In another embodiment of the invention, polynucleotides of the invention comprise, or alternatively consist of, the following polynucleotide sequence encoding the light chain polypeptide sequence of SEQ ID NO: 501: gactatcagatgacccagtctccttccaccctgtctgcatctgtaggagacagagtcaccatcacttgccaggtcagtcagagcatta gtagttggttatcctggtatcagcagaaccaggaaaagcccctaagctcctgatctatagggcatccactctggcatctggagtccatcaaggttcagcggcagtggatctggaacagaattcactctcaccatcagcagcctgcagcctgatgattttgcaacttattactg ccaacaggcttatagtgttagtaatgagataatgattcggcggaggaaccaaggtggaaatcaaacgtacggtgctgcaccatc tgtcttcatcttcccgccatctgatgagcagttgaaatctggaactgcctctgttgtgtgcctgctgaataacttctatcccagagaggc caagtacagtggaaggtggataacgccaccaatcgggtaactcccaggagagtgtcacagagcaggacagcaaggacagca cctacagcctcagcagcaccctgacgctgagcaaagcagactacgagaaacacaaagtctacgcctgcgaagtcaccccatcagg gcctgagctcgcccgtcacaaagagcttcaacaggggagagtgt (SEQ ID NO: 511).

In another embodiment of the invention, polynucleotides of the invention comprise, or alternatively consist of, the following polynucleotide sequence encoding the variable light chain polypeptide sequence of SEQ ID NO: 502: gactatcagatgacccagtctccttccaccctgtctgcatctgtaggagacagagtcaccatcacttgccaggtcagtcagagcatta gtagttggttatcctggtatcagcagaaaccaggaaaagcccctaagctcctgatctatagggcatccactctggcatctggagtcc catcaaggttcagcggcagtggatctggaacagaattcactctcaccatcagcagcctgcagcctgatgattttgcaacttattactgccaacaggcttatagtgttagtaatgttgataatgctttcggcggaggaaccaaggtggaaatcaaacgt (SEQ ID NO: 512).

In another embodiment of the invention, polynucleotides of the invention comprise, or alternatively consist of, the following polynucleotide sequence encoding the constant light chain polypeptide sequence of SEQ ID NO: 510: acggtggctgcaccatctgtcttcatcttcccgccatctgatgagcagttgaaatctggaactgcctctgttgtgtgcctgctgaataac ttctatcccagagaggccaaagtacagtggaaggtggataacgccctccaatcgggtaactcccaggagagtgtcacagagcag gacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt (SEQ ID NO: 520).

In a further embodiment of the invention, polynucleotides encoding antibody fragments having binding specificity to HGF comprise, or alternatively consist of, one or more of the polynucleotide sequences of SEQ ID NO: 494; SEQ ID NO: 496; and SEQ ID NO: 498, which correspond to polynucleotides encoding the complementarity-determining regions (CDRs, or hypervariable regions) of the heavy chain sequence of SEQ ID NO: 481 or the variable heavy chain sequence of SEQ ID NO: 482, and/or one or more of the polynucleotide sequences of SEQ ID NO: 514; SEQ ID NO: 516; and SEQ ID NO: 518, which correspond to the complementarity-determining regions (CDRs, or hypervariable regions) of the light chain sequence of SEQ ID NO: 501 or the variable light chain sequence of SEQ ID NO: 502, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 493; SEQ ID NO: 495; SEQ ID NO: 497; and SEQ ID NO: 499, which correspond to polynucleotides encoding the framework regions (FRs or constant regions) of the heavy chain sequence of SEQ ID NO: 481 or the variable heavy chain sequence of SEQ ID NO: 482, and/or one or more of the polynucleotide sequences of SEQ ID NO: 513; SEQ ID NO: 515; SEQ ID NO: 517; and SEQ ID NO: 519, which correspond to the framework regions (FRs or constant regions) of the light chain sequence of SEQ ID NO: 501 or the variable light chain sequence of SEQ ID NO: 502, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 491 encoding the heavy chain sequence of SEQ ID NO: 481; the polynucleotide SEQ ID NO: 492 encoding the variable heavy chain sequence of SEQ ID NO: 482; the polynucleotide SEQ ID NO: 511 encoding the light chain sequence of SEQ ID NO: 501; the polynucleotide SEQ ID NO: 512 encoding the variable light chain sequence of SEQ ID NO: 502; polynucleotides encoding the complementarity-determining regions (SEQ ID NO: 494; SEQ ID NO: 496; and SEQ ID NO: 498) of the heavy chain sequence of SEQ ID NO: 481 or the variable heavy chain sequence of SEQ ID NO: 482; polynucleotides encoding the complementarity-determining regions (SEQ ID NO: 514; SEQ ID NO: 516; and SEQ ID NO: 518) of the light chain sequence of SEQ ID NO: 501 or the variable light chain sequence of SEQ ID NO: 502; polynucleotides encoding the framework regions (SEQ ID NO: 493; SEQ ID NO: 495; SEQ ID NO: 497; and SEQ ID NO: 499) of the heavy chain sequence of SEQ ID NO: 481 or the variable heavy chain sequence of SEQ ID NO: 482; and polynucleotides encoding the framework regions (SEQ ID NO: 513; SEQ ID NO: 515; SEQ ID NO: 517; and SEQ ID NO: 519) of the light chain sequence of SEQ ID NO: 501 or the variable light chain sequence of SEQ ID NO: 502.

In a preferred embodiment of the invention, polynucleotides of the invention comprise, or alternatively consist of, polynucleotides encoding Fab (fragment antigen binding) fragments having binding specificity for HGF. With respect to antibody Ab13, the polynucleotides encoding the full length Ab13 antibody comprise, or alternatively consist of, the polynucleotide SEQ ID NO: 491 encoding the heavy chain sequence of SEQ ID NO: 481 and the polynucleotide SEQ ID NO: 511 encoding the light chain sequence of SEQ ID NO: 501.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab13 following expression of the full-length polynucleotides in a suitable host. In another embodiment of the invention, anti-HGF antibodies such as Ab13 or Fab fragments thereof may be produced via expression of Ab13 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab14

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 521: cagtcggtggaggagtccgggggtcgcctggtcacgcctgggacacccctgacactcacctgcacagtctctggattctccctca gtaactacgcaatgacct gggtccgccaggctccagggaaggggctggaatggatcggagtcattagttttggtggtaacacatac tacgcgaactgggcgaaaggccgattcaccatctccaaaacctcgaccacggtggatctgaaaatcaccagtccgacaaccgaggacacggccacctatttctgtgccagatgggatgctgaaaacaatgagattcttaacttgtggggccaagggaccctcgtcaccgtc tcgagcgccctccaccaagggcccatcggtcttcccctggcaccctcctccaagagcacctctgggggcacagcggccctgggc tgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgca acgtaatcacaagcccagcaacaccaaggtggacaagagagttgagcccaaatcttgtgacaaaactcacacatgccaccgt gcccagcacctgaactcctgggggggaccgtcagtcttcctatcccccaaaacccaaggacaccctcatgatctcccggacccctgaggtcacatgcgtggtggtggacgtgagccacgaagaccctgaggtcaagttcaactggtacgtggacggcgtggaggtgcat aatgccaagacaaagccgcgggaggagcagtacgccagcacgtaccgtgtggtcagcgtcctcaccgtcctgcaccaggactg gctgaatggcaaggagtacaagtgcaaggtctccaacaaagccctcccagccccatcgagaaaaccatctccaaagccaagg gcagccccgagaaccacaggtgtacaccctgcccccatcccgggaggagatgaccaagaaccaggtcagcctgacctgcctgg tcaaaggcttctatcccagcgacatcgccgtggagtgggagagcaatgggcagccggagaacaactacaagaccacgcctccc gtgctggactccgacggctccttcttcctctacagcaagctcaccgtggacaagagcaggtggcagcaggggaacgtcttctcatg ctccgtgatgcatgaggctctgcacaaccactacacgcagaagagcctctccctgtctccgggtaaa (SEQ ID NO: 531).

In another embodiment of the invention, the polynucleotides of the invention comprise, or alternatively consist of, the following polynucleotide sequence encoding the variable heavy chain polypeptide sequence of SEQ ID NO: 522: cagtcggtggaggagtccgggggtcgcctggtcacgcctgggacacccctgacactcacctgcacagtctctggattctccctca gtaactacgcaatgacctgggtccgccaggctccagggaaggggctggaatggatcggagtcattagttttggtggtaacacatac tacgcgaactgggcgaaaggccgattcaccatctccaaaacctcgaccacggtggatctgaaaatcaccagtccgacaaccgag gacacggccacctatttctgtgccagatgggatgctgaaaacaatgagattcttaacttgtggggccaagggaccctcgtcaccgtc tcgagc (SEQ ID NO: 532).

In another embodiment of the invention, polynucleotides of the invention comprise, or alternatively consist of, the following polynucleotide sequence encoding the constant heavy chain polypeptide sequence of SEQ ID NO: 530: gcctccaccaagggcccatcggtcttcccctggcaccctcctccaagagcacctctgggggcacagcggccctgggctgcctg gtcaaggactacttcccgaaccggtgacggtgtcgtggaactcaggcgccctgaccagcggcgtgcacaccttccggctgtcc tacagtcctcaggactctactccctcagcagcgtggtgaccgtgccctccagcagcttgggcacccagacctacatctgcaacgtg aatcacaagcccagcaacaccaaggtggacaagagagttgagcccaaatcttgtgacaaaactcacacatgccaccgtgccca gcacctgaactcctgggggggaccgtcagtcttcctcttccccccaaaacccaaggacaccctcatgatctcccggacccctgaggt cacatgcgtggtggtggacgtgagccacgaagaccctgaggtcaagttcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagccctcccagccccatcgagaaaaccatctccaaagccaaggcag ccccgagaaccacaggtgtacaccctgcccccatcccgggaggagatgaccaagaaccaggtcagcctgacctgcctggtcaa aggcttctatcccagcgacatcgccgtggagtgggagagcaatgggcagcggagaacaactacaagaccacgcctcccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 540).

In another embodiment of the invention, polynucleotides of the invention comprise, or alternatively consist of, the following polynucleotide sequence encoding the light chain polypeptide sequence of SEQ ID NO: 541: gcctatga- tatgacccagactccagcctctgtggaggtagctgtgggaggcacagtcaccatcaagtgccaggccagtgagagca ttgaaagctatttagcctggtatcagcagaaatcagggcagcctcccaagctcctgatctacagggcttccactctggcatctgggt ctcatcgcggttcaaaggcagtggatctgggacacagttcactctcaccatcagcggcgtggaatgtgccgatgctgccacttacta ctgtcaacagggtgatgcttggagtaatgttgataatgttttcggcggagggaccgaggtggtggtcaaacgtacggtagcggccc catctgtcttcatcttcccgccatctgatgagcagttgaaatctggaactgcctctgttgtgtgcctgctgaataacttctatcccagaga ggccaaagtacagtggaaggtggataacgccctccaatcgggtaactccaggagagtgtcacagagcaggacagcaaggaca gcacctacgcctcagcagcaccctgacgctgagcaaagcagactacgagaaacacaaagtctacgcctgcgaagtcacccatc agggcctgagctcgcccgtcacaaagagcttcaacagggagagtgt (SEQ ID NO: 551).

In another embodiment of the invention, polynucleotides of the invention comprise, or alternatively consist of, the following polynucleotide sequence encoding the variable light chain polypeptide sequence of SEQ ID NO: 542: gcctatgatatgacccagactccagcctctgtggaggtagctgtgggaggcacagtcaccatcaagtgccaggccagtgagagca ttgaaagctatttagcctggtatcagcagaaatcagggcagcctcccaagctcctgatctacagggcttccactctggcatctgggt ctcatcgcggttcaaaggcagtggatctgggacacagttcactctcaccatcagcggcgtggaatgtgccgatgctgccacttactactgtcaacagggtgatgcttggagtaatgttgataatgattcggcggagggaccgaggtggtggtcaaacgt (SEQ ID NO: 552).

In another embodiment of the invention, polynucleotides of the invention comprise, or alternatively consist of, the following polynucleotide sequence encoding the constant light chain polypeptide sequence of SEQ ID NO: 550: acggtagcggccccatctgtcttcatcttcccgccatctgatgagcagttgaaatctggaactgcctctgttgtgtgcctgctgaataa cttctatcccagagaggccaaagtacagtggaaggtggataacgccctccaatcgggtaactcccaggagagtgtcacagagca ggacagcaaggacagcacctacgcctcagcagcaccctgacgctgagcaaagcagactacgagaaacacaaagtctacgcctgcgaagtcacccatcagggcctgagctcgcccgtcacaaagagcttcaacagggagagtgt (SEQ ID NO: 560).

In a further embodiment of the invention, polynucleotides encoding antibody fragments having binding specificity to HGF comprise, or alternatively consist of, one or more of the polynucleotide sequences of SEQ ID NO: 534; SEQ ID NO: 536; and SEQ ID NO: 538, which correspond to polynucleotides encoding the complementarity-determining regions (CDRs, or hypervariable regions) of the heavy chain sequence of SEQ ID NO: 521 or the variable heavy chain sequence of SEQ ID NO: 522, and/or one or more of the polynucleotide sequences of SEQ ID NO: 554; SEQ ID NO: 556; and SEQ ID NO: 558, which correspond to the complementarity-determining regions (CDRs, or hypervariable regions) of the light chain sequence of SEQ ID NO: 541 or the variable light chain sequence of SEQ ID NO: 542, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 533; SEQ ID NO: 535; SEQ ID NO: 537; and SEQ ID NO: 539, which correspond to polynucleotides encoding the framework regions (FRs or constant regions) of the heavy chain sequence of SEQ ID NO: 521 or the variable heavy chain sequence of SEQ ID NO: 522, and/or one or more of the polynucleotide sequences of SEQ ID NO: 553; SEQ ID NO: 555; SEQ ID NO: 557; and SEQ ID NO: 559, which correspond to the framework regions (FRs or constant regions) of the light chain sequence of SEQ ID NO: 541 or the variable light chain sequence of SEQ ID NO: 542, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 531 encoding the heavy chain sequence of SEQ ID NO: 521; the polynucleotide SEQ ID NO: 532 encoding the variable heavy chain sequence of SEQ ID NO: 522; the polynucleotide SEQ ID NO: 551 encoding the light chain sequence of SEQ ID NO: 541; the polynucleotide SEQ ID NO: 552 encoding the variable light chain sequence of SEQ ID NO: 542; polynucleotides encoding the complementarity-determining regions (SEQ ID NO: 534; SEQ ID NO: 536; and SEQ ID NO: 538) of the heavy chain sequence of SEQ ID NO: 521 or the variable heavy chain sequence of SEQ ID NO: 522; polynucleotides encoding the complementarity-determining regions (SEQ ID NO: 554; SEQ ID NO: 556; and SEQ ID NO: 558) of the light chain sequence of SEQ ID NO: 541 or the variable light chain sequence of SEQ ID NO: 542; polynucleotides encoding the framework regions (SEQ ID NO: 533; SEQ ID NO: 535; SEQ ID NO: 537; and SEQ ID NO: 539) of the heavy chain sequence of SEQ ID NO: 521 or the variable heavy chain sequence of SEQ ID NO: 522; and polynucleotides encoding the framework regions (SEQ ID NO: 553; SEQ ID NO: 555; SEQ ID NO: 557; and SEQ ID NO: 559) of the light chain sequence of SEQ ID NO: 541 or the variable light chain sequence of SEQ ID NO: 542.

In a preferred embodiment of the invention, polynucleotides of the invention comprise, or alternatively consist of, polynucleotides encoding Fab (fragment antigen binding) fragments having binding specificity for HGF. With respect to antibody Ab14, the polynucleotides encoding the full length Ab14 antibody comprise, or alternatively consist of, the polynucleotide SEQ ID NO: 531 encoding the heavy chain sequence of SEQ ID NO: 521 and the polynucleotide SEQ ID NO: 551 encoding the light chain sequence of SEQ ID NO: 541.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab14 following expression of the full-length polynucleotides in a suitable host. In another embodiment of the invention, anti-HGF antibodies such as Ab14 or Fab fragments thereof may be produced via expression of Ab14 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab15

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 561: cagtcggtggaggagtccggggtcgcctggtcacgcctggg-acaccctgacactcacctgcacagtactggattctccctca gtaactacgcaat-gacctgggtccgccaggctccagggaaggggctggaatggatcggagtcatt-agttttggtggtaacacatac tacgcgaactgggcgaaaggccgattcac-catctccaaaacctcgaccacggtggatctgaaaatcaccagtccgacaac-cgag gacacggccacctatttctgtgccagatgggatgctgaaaacaatgag-attcttaacttgtggggcccagggaccacgtcaccgtc tcgagcgcctccacca-agggcccatcggtcttcccctggcaccctcctccaagagcacctctgggggca-cagcggccctgggc tgcctggtcaaggactacttccccgaaccggtgacggt-gtcgtggaactcaggcgccctgaccagcggcgtgcacaccttcccggctgtc-ctacagtcctcaggactctactccctcagcagcgtggtgaccgtgccctcca-gcagcttgggcacccagacctacatctgca acgtgaatcacaagcccagca-acaccaaggtggacaagagagttgagcccaaatcttgtgacaaaactcacacat-gcccaccgt gcccagcacctgaactcctgggggggaccgtcagtcttcctct-tccccccaaaacccaaggacaccctcatgatctcccggacccct gaggtca-catgcgtggtggtggacgtgagccacgaagaccctgaggtcaagttcaact-ggtacgtggacggcgtggaggtgcat aatgccaagacaaagccgcgggag-gagcagtacgccagcacgtaccgtgtggtcagcgtcctcaccgtcctgcacca-ggactg gctgaatggcaaggagtacaagtgcaaggtctccaacaaagccctc-ccagccccatcgagaaaaccatctccaaagccaaagg gcagcccga-gaaccacaggtgtacaccctgcccccatcccggaggagatgaccaagaacca-ggtcagcctgacctgcctgg tcaaaggcttctatcccagcgacatcgccgtg-gagtgggagagcaatgggcagccggagaacaactacaagaccacgcctccc-gtgctggactccgacggctccttcttcctctacagcaagctcaccgtggacaa-gagcaggtggcagcaggggaacgtcttctcatg ctccgtgatgcatgaggctct-gcacaaccactacacgcagaagagcctctccctgtaccgggtaaa (SEQ ID NO: 571).

In another embodiment of the invention, the polynucleotides of the invention comprise, or alternatively consist of, the following polynucleotide sequence encoding the variable heavy chain polypeptide sequence of SEQ ID NO: 562: cagtcggtggaggagtccggggtcgcctggtcacgcctgggacaccctgac-actcacctgcacagtctctggattctccctca gtaactacgcaatgacctgggtc-cgccaggctccagggaaggggctggaatggatcggagtcattagttttggtgg-taacacatac tacgcgaactgggcgaaaggccgattcaccataccaaaacctc-gaccacggtggatctgaaaatcaccagtccgacaaccgag gacacggccacct-atttctgtgccagatgggatgctgaaaacaatgagattcttaacttgtggggccca-gggaccctcgtcaccgtc tcgagc (SEQ ID NO: 572).

In another embodiment of the invention, polynucleotides of the invention comprise, or alternatively consist of, the following polynucleotide sequence encoding the constant heavy chain polypeptide sequence of SEQ ID NO: 570: gcctccaccaagggcccatcggtcttccccctggcaccctcctccaagagcac-ctctgggggcacagcggccctgggctgcctg gtcaaggactacttccccgaac-cggtgacggtgtcgtggaactcaggcgccctgaccagcggcgtgcacaccttc-ccggctgtcc tacagtcctcaggactctactccctcagcagcgtggtgaccgtgc-cctccagcagcttgggcacccagacctacatctgcaacgtg aatcacaagc-cagcaacaccaaggtggacaagagagttgagcccaaatcttgtgacaaaact-cacacatgcccaccgtgccca gcacctgaactcctgggggaccgtcagtcttc-ctcttccccccaaaacccaaggacaccctcatgatctcccggacccctgaggt-cacatgcgtggtggtggacgtgagccacgaagacctgaggtcaagttcaact-ggtacgtggacggcgtggaggtgcataatgc caagacaaagccgcgggag-gagcagtacgccagcacgtaccgtgtggtcagcgtcctcaccgtcctgcacca-ggactggctga atggcaaggagtacaagtgcaaggtaccaacaaagccaccca-gcccccatcgagaaaaccatctccaaagccaaagggcag ccccgagaa-ccacaggtgtacaccctgcccccatcccgggaggagatgaccaagaaccag-gtcagcctgacctgcctggtcaa aggcttctatcccagcgacatcgccgtg-gagtgggagagcaatgggcagccggagaacaactacaagaccacgcctc-ccgtgct ggactccgacggctccacttcctctacagcaagctcaccgtg-gacaagagcaggtggcagcaggggaacgtcttctcatgctccg tgatgcatgag-gctctgcacaaccactacacgcagaagagcctctccctgtctccgggtaaa (SEQ ID NO: 580).

In another embodiment of the invention, polynucleotides of the invention comprise, or alternatively consist of, the following polynucleotide sequence encoding the light chain polypeptide sequence of SEQ ID NO: 581: gcctatgatat-gacccagactccagcctctgtggaggtagctgtgggaggcacagtcaccatca-agtgccaggccagtgagagca ttagtagctacttagcctggtatcagca-gaaatcagggcagcctcccaagctcctgatctacagggcttccactctg-gcatctgggt ctcatcgcggttcaaaggcagtggatctgggacacagttcactc-tcaccatcagcggcgtggagtgtgccgatgctgccacttacta ctgtcaaca-gggt gatgatggagtaatgttgataatgttttcggcggagggaccgaggtggtg-gtcaaacgtacggtagcggccc catctgtcttcatcttcccgccatctgatgagca-gttgaaatctggaactgcctctgttgtgtgcctgctgaataacttctatcccagaga-ggccaaagtacagtggaaggtggataacgccaccaatcgggtaactccca-ggagagtgtcacagagcaggacagcaaggaca gcacctacagcctcagcag-caccctgacgctgagcaaagcagactacgagaaacacaaagtctacgcctgc-gaagtcacccatc agggcctgagctcgcccgtcacaaagagcttcaaca-ggggagagtgt (SEQ ID NO: 591).

In another embodiment of the invention, polynucleotides of the invention comprise, or alternatively consist of, the following polynucleotide sequence encoding the variable light chain polypeptide sequence of SEQ ID NO: 582: gcctatgatatgacccagactccagcctctgtggaggtagctgtgggaggcac-agtcaccatcaagtgccaggccagtgagagca ttagtagctacttagcctgg-tatcagcagaaatcagggcagcctcccaagctcctgatctacagggcttc-cactctggcatctgggt ctcatcgcggttcaaaggcagtggatctgggacaca-gttcactctcaccatcagcggcgtggagtgtgccgatgctgccacttacta- ctgt-caacagggtgatgcttggagtaatgttgataatgttttcggcggagggaccg-aggtggtggtcaaacgt (SEQ ID NO: 592).

In another embodiment of the invention, polynucleotides of the invention comprise, or alternatively consist of, the following polynucleotide sequence encoding the constant light chain polypeptide sequence of SEQ ID NO: 590: acggtagcggcccccatctgtcttcatcttcccgccatctgatgagcagttgaaat-ctggaactgcctctgttgtgtgcctgctgaataa cactatccagagaggc-caaagtacagtggaaggtggataacgccaccaatcgggtaactcccagga-gagtgtcacagagca ggacagcaaggacagcacctacagcctcagcagca-ccctgacgctgagcaaagcagactacgagaaacacaaagtctacgcct-gcgaagtcacccatcagggcctgagctcgcccgtcacaaagagcttcaaca-ggggagagtgt (SEQ ID NO: 600).

In a further embodiment of the invention, polynucleotides encoding antibody fragments having binding specificity to HGF comprise, or alternatively consist of, one or more of the polynucleotide sequences of SEQ ID NO: 574; SEQ ID NO: 576; and SEQ ID NO: 578, which correspond to polynucleotides encoding the complementarity-determining regions (CDRs, or hypervariable regions) of the heavy chain sequence of SEQ ID NO: 561 or the variable heavy chain sequence of SEQ ID NO: 562, and/or one or more of the polynucleotide sequences of SEQ ID NO: 594; SEQ ID NO: 596; and SEQ ID NO: 598, which correspond to the complementarity-determining regions (CDRs, or hypervariable regions) of the light chain sequence of SEQ ID NO: 581 or the variable light chain sequence of SEQ ID NO: 582, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 573; SEQ ID NO: 575; SEQ ID NO: 577; and SEQ ID NO: 579, which correspond to polynucleotides encoding the framework regions (FRs or constant regions) of the heavy chain sequence of SEQ ID NO: 561 or the variable heavy chain sequence of SEQ ID NO: 562, and/or one or more of the polynucleotide sequences of SEQ ID NO: 593; SEQ ID NO: 595; SEQ ID NO: 597; and SEQ ID NO: 599, which correspond to the framework regions (FRs or constant regions) of the light chain sequence of SEQ ID NO: 581 or the variable light chain sequence of SEQ ID NO: 582, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 571 encoding the heavy chain sequence of SEQ ID NO: 561; the polynucleotide SEQ ID NO: 572 encoding the variable heavy chain sequence of SEQ ID NO: 562; the polynucleotide SEQ ID NO: 591 encoding the light chain sequence of SEQ ID NO: 581; the polynucleotide SEQ ID NO: 592 encoding the variable light chain sequence of SEQ ID NO: 582; polynucleotides encoding the complementarity-determining regions (SEQ ID NO: 574; SEQ ID NO: 576; and SEQ ID NO: 578) of the heavy chain sequence of SEQ ID NO: 561 or the variable heavy chain sequence of SEQ ID NO: 562; polynucleotides encoding the complementarity-determining regions (SEQ ID NO: 594; SEQ ID NO: 596; and SEQ ID NO: 598) of the light chain sequence of SEQ ID NO: 581 or the variable light chain sequence of SEQ ID NO: 582; polynucleotides encoding the framework regions (SEQ ID NO: 573; SEQ ID NO: 575; SEQ ID NO: 577; and SEQ ID NO: 579) of the heavy chain sequence of SEQ ID NO: 561 or the variable heavy chain sequence of SEQ ID NO: 562; and polynucleotides encoding the framework regions (SEQ ID NO: 593; SEQ ID NO: 595; SEQ ID NO:

597; and SEQ ID NO: 599) of the light chain sequence of SEQ ID NO: 581 or the variable light chain sequence of SEQ ID NO: 582.

In a preferred embodiment of the invention, polynucleotides of the invention comprise, or alternatively consist of, polynucleotides encoding Fab (fragment antigen binding) fragments having binding specificity for HGF. With respect to antibody Ab15, the polynucleotides encoding the full length Ab15 antibody comprise, or alternatively consist of, the polynucleotide SEQ ID NO: 571 encoding the heavy chain sequence of SEQ ID NO: 561 and the polynucleotide SEQ ID NO: 591 encoding the light chain sequence of SEQ ID NO: 581.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab15 following expression of the full-length polynucleotides in a suitable host. In another embodiment of the invention, anti-HGF antibodies such as Ab15 or Fab fragments thereof may be produced via expression of Ab15 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab16

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 601: cagtcggtggaggagtccggggtcgcctggtcacgcctgg-gacaccctgacactcacctgcacagtctctggaatcgacctca gtaattatgcaa-tggggctgggtccgccaggctccagggaagggctggaatacatcggaatgat-tggtgttaatggtagggcatgg tacgcgacttgggcgaaaggccgattcac-catctccaagacctcgcccacggtggatctgaaaatcaccagtccgacaac-cgag gacacggccacctatttctgtgccagattgattgacgagcgttcaactta-tagttatgttttgacttgtggggccaaggcaccctggtc accgtctcgagcgc-ctccaccaagggcccatcggtcttcccccctggcaccctcctccaagagcac-ctctggggg cacagcggccctgggctgcctg ctggggggcacagcgacc ctgggctgcctggtcaaggactacttccccgaac-cggtgacggtgtcgtggaactcaggcgccctgaccagcggcgtgcacacc ttc-ccggctgtcctacagtcctcaggactctactccctcagcagcgtggtgaccgtg-ccctccagcagcttgggcacccagacca catctgcaacgtgaatcacaagc-ccagcaacaccaaggtggacaagagagttgagcccaaatcttgtgacaaaact-cacacatgc ccaccgtgcccagcacctgaactcctggggggaccgtcagtcttc-ctcttccccccaaaacccaaggacaccctcatgatctcccg gacccctg- aggt-cacatgcgtggtggtggacgtgagccacgaagacctgaggtcaagtt-caactggtacgtggacggcgtgga ggtgcataatgccaagacaaagc-cgcgggaggagcagtacgccagcacgtaccgtgtggtcagcgtcctcac-cgtcctgcacca ggactggctgaatggcaaggagtacaagtgcaaggtctc-caacaaagccctcccagcccccatcgagaaaaccatctccaaagc-caaagggcagccccgagaaccacaggtgtacaccctgcccccatcccgggag-gagatgaccaagaaccaggtcagcctgacc tgcctggtcaaaggcttctatc-ccagcgacatcgccgtggagtgggagagcaatgggcagccggagaacaac-tacaagaccac gcctcccgtgctggactccgacggctccttcttcctctacag-caagctcaccgtggacaagagcaggtggcagcaggggaacgtc ttctcat-gctccgtgatgcatgaggctctgcacaaccactacacgcagaagagcctctcc-cctgtctccgggtaaa (SEQ ID NO: 611).

In another embodiment of the invention, the polynucleotides of the invention comprise, or alternatively consist of, the following polynucleotide sequence encoding the variable heavy chain polypeptide sequence of SEQ ID NO: 602: cagtcggtggaggagtccggggtcgcctggtcacgcctgggacaccctg-acactcacctgcacagtctctggaatcgacctca gtaattatgcaatgggct-gggtccgccaggctccagggaagggctggaatacatcggaatgattggtgt-taatggtagggcatgg tacgcgacttgggcgaaaggccgattcaccatctc-caagacctcgcccacggtggatctgaaaatcaccagtccgacaaccgag-gacacggccacctatactgtgccagattgattgacgagcgttcaacttatagtta-tgthttgacttgtggggccaaggcaccctggtc accgtctcgagc (SEQ ID NO: 612).

In another embodiment of the invention, polynucleotides of the invention comprise, or alternatively consist of, the following polynucleotide sequence encoding the constant heavy chain polypeptide sequence of SEQ ID NO: 610: gcctccaccaagggcccatcggtcttccccctggcaccctcctccaagagcac-ctctgggggcacagcggccctgggctgcctg gtcaaggactacttcccc-gaaccggtgacggtgtcgtggaactcaggcgccctgaccagcggcgtgcac-accttcccggctgtcc tacagtcctcaggactctactccctcagcagcgtggt-gaccgtgccctccagcagcttgggcacccagacctacatctgcaacgtg aatca-caagcccagcaacaccaaggtggacaagagagttgagcccaaatcttgt-gacaaaactcacacatgcccaccgtgccca gcacctgaactcctgggggac-cgtcagtcttcctcttccccccaaaacccaaggacaccctcatgatctcccggac-ccctgaggt cacatgcgtggtggtggacgtgagccacgaagacctgaggtc-aagttcaactggtacgtggacggcgtggaggtgcataatgc caagaca- aagc-cgcgggaggagcagtacgccagcacgtaccgtgtggtcagcgtcct- cac-cgtcctgcaccaggactggctga tggcaaggagtacaagtgcaaggtctc-caacaaagccctcccagcccccatcgagaaaaccatctccaaagc-caaagggcag ccccgagaaccacaggtgtacaccctgcccccatcccgggag-gagatgaccaagaaccaggtcagcctgacctgcctggtcaa aggcttct- atc-cagcgacatcgccgtggagtgggagagcaatgggcagcggagaaca-actacaagaccacgcctcccgtgct ggactccgacggctccttcttcctctacag-caagctcaccgtggacaagagcaggtggcagcaggggaacgtcttctcat-gctccg tgatgcatgaggctctgcacaaccactacacgcagaagagcctctccct-gtctccgggtaaa (SEQ ID NO: 620).

In another embodiment of the invention, polynucleotides of the invention comprise, or alternatively consist of, the following polynucleotide sequence encoding the light chain polypeptide sequence of SEQ ID NO: 621: caagtgctgac-ccagactccatccctgtgtctgcagctgtgggaggcacagtcaccatcaactg-ccagggcagtcagagtctttat aataacaacgccttacctggtatcagcagaaac-cagggcagcctcccaagacctgatctatgatgcttccactctggcgtctgggg-tcccatcgcggttcaaaggcagtggatctgggacacagttcactctcaccatca-gtggcgtgcagtgtgcagatgctgccacttact actgtcaaggcgaatttagtt-gtggtgatgttgattgtattgctttcggcggagggaccgaggtggtggtcaaacg-tacggtagcgg ccccatctgtcttcatcacccgccatctgatgagcagttgaaa-tctggaactgcctctgttgtgtgcctgctgaataacttctatcccag agaggcc-aaagtacagtggaaggtggataacgccctccaatcgggtaactcccaggagag-tgtcacagagcaggacagcaagg acagcacctacagcctcagcagcaccct-gacgctgagcaaagcagactacgagaaacacaaagtctacgcctgcgaagt-cacc catcagggcctgagctcgcccgtcacaaagagcttcaacaggggga-gagtgt (SEQ ID NO: 631).

In another embodiment of the invention, polynucleotides of the invention comprise, or alternatively consist of, the following polynucleotide sequence encoding the variable light chain polypeptide sequence of SEQ ID NO: 622: caagtgctgacccagactccatccctgtgtctgcagagtgggaggcacagtc-accatcaactgccagggcagtcagagtattat aataacaacgccttttcctgg-tatcagcagaaaccagggcagcctcccaagctcctgatctatgatgcttc-cactctggcgtctgggg tcccatcgcggttcaaaggcagtggatctggga-cacagttcactctcaccatcagtggcgtgcagtgtgcagatgctgccacttact actgtcaaggcgaatttagagtggtgatgttgattgtattgctttcggcggag-ggaccgaggtggtggtcaaacgt (SEQ ID NO: 632).

In another embodiment of the invention, polynucleotides of the invention comprise, or alternatively consist of, the following polynucleotide sequence encoding the constant light chain polypeptide sequence of SEQ ID NO: 630: acggtagcggccccatctgtcttcatcttcccgccatctgatgagcagttgaa-atctggaactgcctctgttgtgtgcctgctgaataa cttctatcccagagaggccaaagtacagtggaaggtggataacgccaccaatcgggtaactcccag-
gagagtgtcacagagca ggacagcaaggacagcacctacagcctcagcagca-
ccctgacgctgagcaaagcagactacgagaaacacaaagtctacgcct
gcgaagtcacccatcagggcctgagctcgcccgtcacaaagagcttcaaca-
gggagagtgt (SEQ ID NO: 640).

In a further embodiment of the invention, polynucleotides encoding antibody fragments having binding specificity to HGF comprise, or alternatively consist of, one or more of the polynucleotide sequences of SEQ ID NO: 614; SEQ ID NO: 616; and SEQ ID NO: 618, which correspond to polynucleotides encoding the complementarity-determining regions (CDRs, or hypervariable regions) of the heavy chain sequence of SEQ ID NO: 601 or the variable heavy chain sequence of SEQ ID NO: 602, and/or one or more of the polynucleotide sequences of SEQ ID NO: 634; SEQ ID NO: 636; and SEQ ID NO: 638, which correspond to the complementarity-determining regions (CDRs, or hypervariable regions) of the light chain sequence of SEQ ID NO: 621 or the variable light chain sequence of SEQ ID NO: 622, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 613; SEQ ID NO: 615; SEQ ID NO: 617; and SEQ ID NO: 619, which correspond to polynucleotides encoding the framework regions (FRs or constant regions) of the heavy chain sequence of SEQ ID NO: 601 or the variable heavy chain sequence of SEQ ID NO: 602, and/or one or more of the polynucleotide sequences of SEQ ID NO: 633; SEQ ID NO: 635; SEQ ID NO: 637; and SEQ ID NO: 639, which correspond to the framework regions (FRs or constant regions) of the light chain sequence of SEQ ID NO: 621 or the variable light chain sequence of SEQ ID NO: 622, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 611 encoding the heavy chain sequence of SEQ ID NO: 601; the polynucleotide SEQ ID NO: 612 encoding the variable heavy chain sequence of SEQ ID NO: 602; the polynucleotide SEQ ID NO: 631 encoding the light chain sequence of SEQ ID NO: 621; the polynucleotide SEQ ID NO: 632 encoding the variable light chain sequence of SEQ ID NO: 622; polynucleotides encoding the complementarity-determining regions (SEQ ID NO: 614; SEQ ID NO: 616; and SEQ ID NO: 618) of the heavy chain sequence of SEQ ID NO: 601 or the variable heavy chain sequence of SEQ ID NO: 602; polynucleotides encoding the complementarity-determining regions (SEQ ID NO: 634; SEQ ID NO: 636; and SEQ ID NO: 638) of the light chain sequence of SEQ ID NO: 621 or the variable light chain sequence of SEQ ID NO: 622; polynucleotides encoding the framework regions (SEQ ID NO: 613; SEQ ID NO: 615; SEQ ID NO: 617; and SEQ ID NO: 619) of the heavy chain sequence of SEQ ID NO: 601 or the variable heavy chain sequence of SEQ ID NO: 602; and polynucleotides encoding the framework regions (SEQ ID NO: 633; SEQ ID NO: 635; SEQ ID NO: 637; and SEQ ID NO: 639) of the light chain sequence of SEQ ID NO: 621 or the variable light chain sequence of SEQ ID NO: 622.

In a preferred embodiment of the invention, polynucleotides of the invention comprise, or alternatively consist of, polynucleotides encoding Fab (fragment antigen binding) fragments having binding specificity for HGF. With respect to antibody Ab16, the polynucleotides encoding the full length Ab16 antibody comprise, or alternatively consist of, the polynucleotide SEQ ID NO: 611 encoding the heavy chain sequence of SEQ ID NO: 601 and the polynucleotide SEQ ID NO: 631 encoding the light chain sequence of SEQ ID NO: 621.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab16 following expression of the full-length polynucleotides in a suitable host. In another embodiment of the invention, anti-HGF antibodies such as Ab16 or Fab fragments thereof may be produced via expression of Ab16 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab17

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 641: cagtcggtggaggagtccggggtcgcctggtcccgcctggga-
caccctgacactcacctgcacagtctctggaatcgacctca gtagctatgcaat-
gggctgggtccgccaggctccagggaaggggctggaatacatcggaatgatt-
gatgttagtggtagcacgta ctacgcggactgggcgaaaggccgactcac-
catctccaaaacccgaccacggtggatctggaaatcaccagtccgacaaccg-
aggacacggccacctatttctgtgccagattgattgacgagcgttcaacttata-
gttatgctatgacttgtgggccaaggcaccac gtcaccgtctcgagcgcctc-
caccaagggcccatcggtcttcccctggcaccctcctccaagagcac-
ctctgggggcacagcg gccctgggctgcctggtcaaggactacttec-
ccgaaccggtgacggtgtcgtggaactcaggcgccctgaccagcggcgtgcac-
accttccggctgtcctacagtcctcaggactctactccctcagcagcgtggt-
gaccgtgccaccagcagcttgggcacccagac ctacatctgcaacgtgaatca-
caagcccagcaacaccaaggtggacaagagagttgagcccaaatcttgt-
gacaaaactcacaca tgcccaccgtgcccagcacctgaactcctgggggacc-
gtcagtcttcctcttcccccaaaacccaaggacaccctcatgatctc ccggac-
ccctgaggtcacatgcgtggtggtggacgtgagccacgaagaccctgagg-
tcaagttcaactggtacgtggacggcgt ggaggtgcataatgccaagacaaagc-
cgcgggaggagcagtacgccagcacgtaccgtgtggtcagcgtcctcac-
cgtcctgc accaggactggctgaatggcaaggagtacaagtgcaaggtctc-
caacaaagccctcccagcccccatcgagaaaaccatctcca aagccaa-
agggcagccccgagaaccacaggtgtacaccctgcccccatcccgggaggagatgaccaagaaccaggtcagcct gacctgcctggtcaaaggcttctatccagcgacatcgccgtggagtgggagagcaatgggcagccggagaacaactacaagaccacgcctcccgtgctggactccgacggctccttcttcctctacagcaagctcaccgtggacaagagcaggtggcagcagggga acgtcttctcatgctccgtgatgcatgaggctctgcacaaccactacacgcagaagagcctctccctgtctccgggtaaa (SEQ ID NO: 651).

In another embodiment of the invention, the polynucleotides of the invention comprise, or alternatively consist of, the following polynucleotide sequence encoding the variable heavy chain polypeptide sequence of SEQ ID NO: 642: cagtcggtggaggagtccggggggtcgcctggtcccgcctgggacacccctgacactcacctgcacagtctctggaatcgacctca gtagctatgcaatgggctgggtccgccaggctccagggaaggggctggaatacatcggaatgattgatgttagtggtagcacgta ctacgcggactgggcgaaaggccgactcaccatctccaaaacccgaccacggtggatctggaaatcaccagtccgacaaccg aggacacggccacctatttctgtgccagattgattgacgagcgttcaacttatagttatgcattgacttgtggggccaaggcaccctc gtcaccgtctcgagc (SEQ ID NO: 652).

In another embodiment of the invention, polynucleotides of the invention comprise, or alternatively consist of, the following polynucleotide sequence encoding the constant heavy chain polypeptide sequence of SEQ ID NO: 650: gcctccaccaagggcccatcggtcttccccctggcaccctcctccaagagcacctctgggggcacagcggccctgggctgcctg gtcaaggactacttccccgaaccggtgacggtgtcgtggaactcaggcgccctgaccagcggcgtgcacaccttccgggctgtcc tacagtcctcaggactctactccctcagcagcgtggtgaccgtgccctccagcagcttgggcacccagacctacatctgcaacgtg aatcacaagcccagcaacaccaaggtggacaagagagttgagcccaaatcagtgacaaaactcacacatgcccaccgtgccca gcacctgaactctggggggaccgtcagtcttcctatcccccaaaacccaaggacaccctcatgatctcccggacccctgaggt cacatgcgtggtggtggacgtgagccacgaagacctgaggtcaagttcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagccctcccagcccccatcgagaaaaccatctccaaagccaaagggcag ccccgagaaccacaggtgtacaccctgcccccatcccgggaggagatgaccaagaaccaggtcagcctgacctgcctggtcaa aggcttctatcccagcgacatcgccgtggagtgggagagcaatgggcagccggagaacaactacaagaccacgcctcccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 660).

In another embodiment of the invention, polynucleotides of the invention comprise, or alternatively consist of, the following polynucleotide sequence encoding the light chain polypeptide sequence of SEQ ID NO: 661: caagtgctgacccagactccatccctgtgtctgcagctgtgggaggcacagtcaccatcaact gccaggccagtcagagtttttat aataacggcgccttttcctggtatcagcagaaaccagggcagcctcccaagctcctgatctacgatgcatccactctg gcatctggg gtcccatcgcggttcaaaggcagtggatctgggacagtt cactctcaccatcagcggcgtacagtgtgagatgctgccactta ctactgt caagg cgaatttagttgtggtagtgctgattgtgttgctttcggcggagggaccgaggtggtggtcaaacgtacggtagc ggccccatctgtcttcatcttcccgccatctgatgagcagttgaaatctggaactgcctctgttgtgtgcctgctgaataact tctatccc agagaggccaaagtacagtggaaggtggataacgccctcca atcgggtaactcccaggagagtgtcacagagcaggacagcaa ggcagcc acctacagcctcagcagcaccctgacgctgagcaaagcagactacgagaaa cacaaagtctacgcctgcgaagtca cccatcagggcctgagctcgcccgtca caaagagcttcaacaggggagagtgt (SEQ ID NO: 671).

In another embodiment of the invention, polynucleotides of the invention comprise, or alternatively consist of, the following polynucleotide sequence encoding the variable light chain polypeptide sequence of SEQ ID NO: 662: caagtgctgacccagactccatccctgtgtctgcagctgtgggaggcacagtcaccatcaactgccaggccagtcagagtttttat aataacggcgccttttcctggtatcagcagaaaccagggcagcctcccaagctcctgatctacgatgcatccactctggcatctggg gtcccatcgcggttcaaaggcagtggatctgggacacagttcactctcaccatcatggcgtacagtgtgagatgctgccactta ctactgt caagg gcgaatttagttgtggtagtgctgattgtgttgctttcggcggagggaccgaggtggtggtcaaacgt (SEQ ID NO: 672).

In another embodiment of the invention, polynucleotides of the invention comprise, or alternatively consist of, the following polynucleotide sequence encoding the constant light chain polypeptide sequence of SEQ ID NO: 670: acgg tagcggccccatctgtcttcatcttcccgccatctgatgagcagttgaaatct ggaactgcctctgagtgtgcctgctgaataa atctatcccagagaggccaaagta cagtggaaggtggataacgccaccaatcgggtaactcccaggagagtgtcaca gagca ggacagcaaggacagcacctacagcctcagcagcaccctgacgct gagcaaagcagactacgagaaacacaaagtctacgcct gcgaagtcac ccatcagggcctgagctcgcccgtcacaaagagcttcaacaggggagagtgt (SEQ ID NO: 680).

In a further embodiment of the invention, polynucleotides encoding antibody fragments having binding specificity to HGF comprise, or alternatively consist of, one or more of the polynucleotide sequences of SEQ ID NO: 654; SEQ ID NO: 656; and SEQ ID NO: 658, which correspond to polynucleotides encoding the complementarity-determining regions (CDRs, or hypervariable regions) of the heavy chain sequence of SEQ ID NO: 641 or the variable heavy chain sequence of SEQ ID NO: 642, and/or one or more of the polynucleotide sequences of SEQ ID NO: 674; SEQ ID NO: 676; and SEQ ID NO: 678, which correspond to the complementarity-determining regions (CDRs, or hypervariable regions) of the light chain sequence of SEQ ID NO: 661 or the variable light chain sequence of SEQ ID NO: 662, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 653; SEQ ID NO: 655; SEQ ID NO: 657; and SEQ ID NO: 659, which correspond to polynucleotides encoding the framework regions (FRs or constant regions) of the heavy chain sequence of SEQ ID NO: 641 or the variable heavy chain sequence of SEQ ID NO: 642, and/or one or more of the polynucleotide sequences of SEQ ID NO: 673; SEQ ID NO: 675; SEQ ID NO: 677; and SEQ ID NO: 679, which correspond to the framework regions (FRs or constant regions) of the light chain sequence of SEQ ID NO: 661 or the variable light chain sequence of SEQ ID NO: 662, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 651 encoding the heavy chain sequence of SEQ ID NO: 641; the polynucleotide SEQ ID NO: 652 encoding the variable heavy chain sequence of SEQ ID NO: 642; the polynucleotide SEQ ID NO: 671 encoding the light chain sequence of SEQ ID NO: 661; the polynucleotide SEQ ID NO: 672 encoding the variable light chain sequence of SEQ ID NO: 662; polynucleotides encoding the complementarity-determining regions (SEQ ID NO: 654; SEQ ID NO: 656; and SEQ ID NO: 658) of the heavy chain sequence of SEQ ID NO: 641 or the variable heavy chain sequence of SEQ ID NO: 642; polynucleotides encoding the complementarity-determining regions (SEQ ID NO: 674; SEQ ID NO: 676; and SEQ ID NO: 678) of the light chain sequence of SEQ ID NO: 661 or the variable light chain sequence of SEQ ID NO: 662; polynucleotides encoding the framework regions (SEQ ID NO: 653; SEQ ID NO: 655; SEQ ID NO: 657; and SEQ ID NO: 659) of the heavy chain sequence of SEQ ID NO: 641 or the variable heavy chain sequence of SEQ ID NO: 642; and polynucleotides encoding the framework regions (SEQ ID NO: 673; SEQ ID NO: 675; SEQ ID NO: 677; and SEQ ID NO: 679) of the light chain sequence of SEQ ID NO: 661 or the variable light chain sequence of SEQ ID NO: 662.

In a preferred embodiment of the invention, polynucleotides of the invention comprise, or alternatively consist of, polynucleotides encoding Fab (fragment antigen binding) fragments having binding specificity for HGF. With respect to antibody Ab17, the polynucleotides encoding the full length Ab17 antibody comprise, or alternatively consist of, the polynucleotide SEQ ID NO: 651 encoding the heavy chain sequence of SEQ ID NO: 641 and the polynucleotide SEQ ID NO: 671 encoding the light chain sequence of SEQ ID NO: 661.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab17 following expression of the full-length polynucleotides in a suitable host. In another embodiment of the invention, anti-HGF antibodies such as Ab17 or Fab fragments thereof may be produced via expression of Ab17 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab18

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 681: cagtcgctggaggagtccggggtcgcctggtcacgcctgggac-acccctgacactcacctgcacagcctctggattctccctca gcagctacgacat-gagctgggtccgccaggctccagggaaggggctggaatggatcggaatcatt-tatgctggtagtgctagcac atggttcgcgagctgggtgaaaggccgattcac-catctccaaacctcgaccacggtggatctgaaaatgaccagtctgacaacc gaggacacggccacctatttctgtgccagagtgggttatagtggttatggttatg-atgataatttggacatgtggggccaaggcaccc tcgtcaccgtctcgagcgc-ctccaccaagggcccatcggtcttcccctggcaccctcctccaagagca-cctctgggggcacagc ggccctgggctgcctggtcaaggactacttccccgaac-cggtgacggtgtcgtggaactcaggcgccctgaccagcggcgtgca cacct-teccggctgtcctacagtcctcaggactctactccctcagcagcgtggtgaccgt-gccctccagcagcttgggcacccaga cctacatctgcaacgtgaatcacaagc-ccagcaacaccaaggtggacaagagagttgagcccaaatcttgtgacaaaact-cacac atgcccaccgtgcccagcacctgaactcctggggggaccgtcagtct-tcctcttcccccccaaaacccaaggacaccctcatgatct cccggaccctgag-gtcacatgcgtggtggtggacgtgagccacgaagaccctgaggtcaag-ttcaactggtacgtggacggcg tggaggtgcataatgccaagacaaagc-cgcgggaggagcagtacgccagcacgtaccgtgtggtcagcgtcctcac-cgtcctgc accaggactggctgaatggcaaggagtacaagtgcaaggtctcc-aacaaagccctcccagcccccatcgagaaaaccatctcca aagccaaa-gggcagccccgagaaccacaggtgtacaccctgcccccatcccgggaggag-atgaccaagaaccaggtcagcct gacctgcctggtcaaaggcttctatcccag-cgacatcgccgtggagtgggagagcaatgggcagccggagaacaactacaaga ccacgcctcccgtgctggactccgacggctccttcttcctctacagcaagctc-accgtggacaagagcaggtggcagcagggga acgtcttctcatgctccgtgat-gcatgaggctctgcacaaccactacacgcagaagagcctctccctgtctccggg-taaa (SEQ ID NO: 691).

In another embodiment of the invention, the polynucleotides of the invention comprise, or alternatively consist of, the following polynucleotide sequence encoding the variable heavy chain polypeptide sequence of SEQ ID NO: 682: cagtcgctggaggagtccggggtcgcctggtcacgcctgggacaccctga-cactcacctgcacagcctctggattctccctca gcagctacgacatgagctgg-gtccgccaggctccagggaaggggctggaatggatcggaatcatttatgctggt-agtgctagcac atggttcgcgagctgggtgaaaggccgattcaccatctccaa-aacctcgaccacggtggatctgaaaatgaccagtctgacaacc gaggacacg-gccacctatttctgtgccagagtgggttatagtggttatggttatgatgaatttg-gacatgtggggccaaggcaccc tcgtcaccgtctcgagc (SEQ ID NO: 692).

In another embodiment of the invention, polynucleotides of the invention comprise, or alternatively consist of, the following polynucleotide sequence encoding the constant heavy chain polypeptide sequence of SEQ ID NO: 690: gcctccaccaagggcccatcggtcttcccctggcaccctcctccaagagcacc-tctgggggcacagcggccctgggctgcctg gtcaaggactacttccccgaac-cggtgacggtgtcgtggaactcaggcgccctgaccagcggcgtgcacacct-teccggctgtcc tacagtcctcaggactctactccctcagcagcgtggtgac-cgtgccctccagcagcttgggcacccagacctacatctgcaacgtg aatcaca-agcccagcaacaccaaggtggacaagagagttgagcccaaatcttgtgacaaa-aactcacacatgcccaccgtgccca gcacctgaactcctggggggaccgtca-gtcttcctcttcccccccaaaacccaaggacaccctcatgatctcccggaccct-gaggt cacatgcgtggtggtggacgtgagccacgaagaccctgaggtcaa-gttcaactggtacgtggacgcgtggaggtgcataatgc caagacaaa-gccgcgggaggagcagtacgccagcacgtaccgtgtggtcagcgtcctcac-cgtcctgcaccaggactggctga atggcaaggagtacaagtgcaaggtctc-caacaaagccctcccagcccccatcgagaaaaccatctccaaagccaaagg-gcag ccccgagaaccacaggtgtacaccctgcccccatcccgggaggagat-gaccaagaaccaggtcagcctgacctgcctggtcaa aggcttctatcccagc-gacatcgccgtggagtgggagagcaatgggcagccggagaacaacta-caagaccacgcctcccgtgct ggactccgacggctccttcttcctctacag-caagctcaccgtggacaagagcaggtggcagcaggggaacgtcttctcat-gaccg tgatgcatgaggctctgcacaaccactacacgcagaagagcctctccct-gtctccgggtaaa (SEQ ID NO: 700).

In another embodiment of the invention, polynucleotides of the invention comprise, or alternatively consist of, the following polynucleotide sequence encoding the light chain polypeptide sequence of SEQ ID NO: 701: gcctatgata-tgacccagactccagcctctgtggaggtagctgtgggaggcacagtcaccatc-aagtgccaggccagtcagagca ttagcactgcattagcctggtatcagca-gaaaccagggcagcgtcccaagctcctgatctacgatgcatcgaaactg-gcatctggg gtctcatcgcggttcaaaggcagtggatctggggcacag-ttcactctcaccatcagcggcgtggagtgtgccgatgctgccactta ctact-gtcaccagggttatagtagtaataatgttgataatactttcggcggagggaccga-ggtggtggtcaaacgtacggtagcggc cccatctgtcttcatcttcccgccatct-gatgagcagttgaaatctggaactgcctctgttgtgtgcctgctgaataacttc-tatcccaga gaggccaaagtacagtggaaggtggataacgccctccaat-cgggtaactcccaggagagtgtcacagagcaggacagcaagga cagcac-ctac agcctcagcagcaccctgacgctgagcaaagcagactacgagaaac-acaaagtctacgcctgcgaagtcaccc atcagggcctgagctcgcccgtca-caaagagcttcaacaggggagagtgt (SEQ ID NO: 711).

In another embodiment of the invention, polynucleotides of the invention comprise, or alternatively consist of, the following polynucleotide sequence encoding the variable light chain polypeptide sequence of SEQ ID NO: 702: gcctatgatatgacccagactccagcctctgtggaggtagctgtgggaggcaca-gtcaccatcaagtgccaggccagtcagagca ttagcactgcattagcctgg-tatcagcagaaaccagggcagcgtcccaagctcctgatctacgatgcatc-gaaactggcatctggg gtctcatcgcggttcaaaggcagtggatctggggcaca-gttcactctcaccatcagcggcgtggagtgtgccgatgctgccactta ctactgt-caccagggttatagtagtagtaatgttgataatactttcggcggagggaccgag-gtggtggtcaaacgt (SEQ ID NO: 712).

In another embodiment of the invention, polynucleotides of the invention comprise, or alternatively consist of, the following polynucleotide sequence encoding the constant light chain polypeptide sequence of SEQ ID NO: 710: acggtagcggcccccatctgtcttcatatcccgccatctgatgagcagttgaaatc-tggaactgcctctgagtgtgcctgctgaataa cttctatcccagagaggccaaag-tacagtggaaggtggataacgccctccaatcgggtaactcccaggagagtgt-cacagagca ggacagcaaggacagcacctacagcctcagcagcaccct-gacgctgagcaaagcagactacgagaaacacaaagtctacgcct gcgaagt-cacccatcagggcctgagctcgcccgtcacaaagagettcaacaggggagagtgt (SEQ ID NO: 720).

In a further embodiment of the invention, polynucleotides encoding antibody fragments having binding specificity to HGF comprise, or alternatively consist of, one or more of the polynucleotide sequences of SEQ ID NO: 694; SEQ ID NO: 696; and SEQ ID NO: 698, which correspond to polynucleotides encoding the complementarity-determining regions (CDRs, or hypervariable regions) of the heavy chain sequence of SEQ ID NO: 681 or the variable heavy chain sequence of SEQ ID NO: 682, and/or one or more of the polynucleotide sequences of SEQ ID NO: 714; SEQ ID NO: 716; and SEQ ID NO: 718, which correspond to the complementarity-determining regions (CDRs, or hypervariable regions) of the light chain sequence of SEQ ID NO: 701 or the variable light chain sequence of SEQ ID NO: 702, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 693; SEQ ID NO: 695; SEQ ID NO: 697; and SEQ ID NO: 699, which correspond to polynucleotides encoding the framework regions (FRs or constant regions) of the heavy chain sequence of SEQ ID NO: 681 or the variable heavy chain sequence of SEQ ID NO: 682, and/or one or more of the polynucleotide sequences of SEQ ID NO: 713; SEQ ID NO: 715; SEQ ID NO: 717; and SEQ ID NO: 719, which correspond to the framework regions (FRs or constant regions) of the light chain sequence of SEQ ID NO: 701 or the variable light chain sequence of SEQ ID NO: 702, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 691 encoding the heavy chain sequence of SEQ ID NO: 681; the polynucleotide SEQ ID NO: 692 encoding the variable heavy chain sequence of SEQ ID NO: 682; the polynucleotide SEQ ID NO: 711 encoding the light chain sequence of SEQ ID NO: 701; the polynucleotide SEQ ID NO: 712 encoding the variable light chain sequence of SEQ ID NO: 702; polynucleotides encoding the complementarity-determining regions (SEQ ID NO: 694; SEQ ID NO: 696; and SEQ ID NO: 698) of the heavy chain sequence of SEQ ID NO: 681 or the variable heavy chain sequence of SEQ ID NO: 682; polynucleotides encoding the complementarity-determining regions (SEQ ID NO: 714; SEQ ID NO: 716; and SEQ ID NO: 718) of the light chain sequence of SEQ ID NO: 701 or the variable light chain sequence of SEQ ID NO: 702; polynucleotides encoding the framework regions (SEQ ID NO: 693; SEQ ID NO: 695; SEQ ID NO: 697; and SEQ ID NO: 699) of the heavy chain sequence of SEQ ID NO: 681 or the variable heavy chain sequence of SEQ ID NO: 682; and polynucleotides encoding the framework regions (SEQ ID NO: 713; SEQ ID NO: 715; SEQ ID NO: 717; and SEQ ID NO: 719) of the light chain sequence of SEQ ID NO: 701 or the variable light chain sequence of SEQ ID NO: 702.

In a preferred embodiment of the invention, polynucleotides of the invention comprise, or alternatively consist of, polynucleotides encoding Fab (fragment antigen binding) fragments having binding specificity for HGF. With respect to antibody Ab18, the polynucleotides encoding the full length Ab18 antibody comprise, or alternatively consist of, the polynucleotide SEQ ID NO: 691 encoding the heavy chain sequence of SEQ ID NO: 681 and the polynucleotide SEQ ID NO: 711 encoding the light chain sequence of SEQ ID NO: 701.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab18 following expression of the full-length polynucleotides in a suitable host. In another embodiment of the invention, anti-HGF antibodies such as Ab18 or Fab fragments thereof may be produced via expression of Ab18 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab19

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 721: cagtcggtggaggagtccggggggtcgcctggtcacgcctgggac-acccctgacactcacctgcacagcctctggattctccctca gtaattattg-gatgggctgggtccgccaggctccaggggagggctggaatggatcggaa-ccattagttatgatggtaacacatac tacgcgagctgggcaaaaggccgcttcaccatctcccgaacctcgaccacggtggatctgaaaatgaccagtctgacgaccgag gacacggccatctatttctgtgccacagtcaattatcctgattatagtactggtgcctttaacatctggggcccaggcaccctcgtcac cgtacgagcgcctccaccaagggcccatcggtcttcccctggcaccctcctccaagagcacctctgggggcacagcggccct gggctgcctggtcaaggactacttccccgaaccggtgacggtgtcgtggaactcaggcgccctgaccagcggcgtgcacaccttccggctgtcctacagtcctcaggactctactccctcagcagcgtggtgaccgtgccaccagcagcttgggcacccagacctaca tctgcaacgtgaatcacaagcccagcaacaccaaggtggacaagagagttgagcccaaatcttgtgacaaaactcacacatgccc accgtgcccagcacctgaactcctgggggaccgtcagtct- tcctcttccccccaaaacccaaggacaccctcatgatctcccggacccctgaggtcacatgcgtggtggtggacgtgagccacgaagaccctgaggtcaagttcaactggtacgtggacggcgtggagg tgcataatgccaagacaaagccgcgggaggagcagtacgccagcacgtaccgtgtggtcagcgtcctcaccgtcctgcaccagg actggctgaatggcaaggagtacaagtgcaaggtctccaacaaagcccTcccagcccccatcgagaaaaccatctccaaagccaaagggcagccccgagaaccacaggtgtacaccctgccccatcccgggagatgaccaagaaccaggtcagcctgacctg cctggtcaaaggcttctatccagcgacatcgccgtggagtgggagagcaatgggcagccggagaacaactacaagaccacgc ctcccgtgctggactccgacggctccttcttcctctacagcaagctcaccgtggacaagagcaggtggcagcaggggaacgtcttc tcatgctccgtgatgcatgaggctctgcacaaccactacacgcagaagagcctctccctgtctccgggtaaa (SEQ ID NO: 731).

In another embodiment of the invention, the polynucleotides of the invention comprise, or alternatively consist of, the following polynucleotide sequence encoding the variable heavy chain polypeptide sequence of SEQ ID NO: 722: cagtcggtggaggagtccggggtcgcctggtcacgcctgggacaccctgacactcacctgcacagcctctggattctccctca gtaattattggatgggctgggtcgccaggctccaggggaggggctggaatggatcggaaccattagttatgatggtaacacatac tacgcgagctgggcaaaaggccgcttcaccatctcccgaacctcgaccacggtggatctgaaaatgaccagtctgacgaccgag gacacggccatctatactgtgccacagtcaattatcctgattatagtactggtgcctttaacatctggggcccaggcaccacgtcac cgtctcgagc (SEQ ID NO: 732).

In another embodiment of the invention, polynucleotides of the invention comprise, or alternatively consist of, the following polynucleotide sequence encoding the constant heavy chain polypeptide sequence of SEQ ID NO: 730: gcctccaccaagggcccatcggtcttcccctggcaccctcctccaagagcacctctgggggcacagcggccctgggctgcctg gtcaaggactacttccccgaaccgg gacggtgtcgtggaactcaggcgccctgaccagcggcgtgcacaccttccggctgtcc tacagtcctcaggactctactccctcagcagcgtggtgaccgtgccctccagcagcttgggcacccagacctacatctgcaacgtg aatcaagcccagcaacaccaaggtggacaagagagttgagcccaaatctgtgacaaaactcacacatgcccaccgtgcccaggggac cgtcagtcttcctcttccccccaaaacccaaggacaccctcatgatctcccggac--ccctgaggt cacatgcgtggtggtggacgtgagccacgaagaccctgaggtcaagttcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagcccTcccagcccccatcgagaaaaccatctccaaagccaaagggcag ccccgagaaccacaggtgtacaccctgccccatcccgggaggagatgaccaagaaccaggtcagcctgacctgcctggtcaa aggctTctatcccagcgacatcgccgtggagtgggagagcaatgggcagccggagaacaactacaagaccacgcctcccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 740).

In another embodiment of the invention, polynucleotides of the invention comprise, or alternatively consist of, the following polynucleotide sequence encoding the light chain polypeptide sequence of SEQ ID NO: 741: gatgttgtgatgacccagactccagcctccgtgtctgaacctgtggaggcacagtcaccatcaagtgccaggccagtcagagcat tgataactacttagcctggtatcagcagaaaccagggcagcgtcccaggctcctgatctattatacatccactctggcatctggggtcccatcgcggttcaaaggcagtggatctgggacagagtacactctcaccatcagcgacctggagtgtgccgatgctgccacttacta ctgtcaatttactgcttattatagtacttatattggagctttcggcggagggaccgaggtggtggtcaaacgtacggtagcggccccat ctgtcttcatcttcccgccatctgatgagcagttgaaatctggaactgcctctgttgtgtgcctgctgaataacttctatcccagagagg ccaaagtacagtggaaggtggataacgccctccaatcgggtaactcccaggagagtgtcacagagcaggacagcaaggacagc acctacagcctcagcagcaccctgacgctgagcaaagcagactacgagaaacacaaagtctacgcctgcgaagtcacccatcag ggcctgagctcgcccgtcacaaagagcttcaacaggggagagtgt (SEQ ID NO: 751).

In another embodiment of the invention, polynucleotides of the invention comprise, or alternatively consist of, the following polynucleotide sequence encoding the variable light chain polypeptide sequence of SEQ ID NO: 742: gatgttgtgatgacccagactccagcctccgtgtctgaacctgtggaggcacagtcaccatcaagtgccaggccagtcagagcat tgataactacttagcctggtatcagcagaaaccagggcagcgtcccaggctcctgatctattatacatccactctggcatctggggtc ccatcgcggttcaaaggcagtggatctgggacagagtacactctcaccatcagcgacctggagtgtgccgatgctgccacttacta ctgtcaatttactgcttattatagtacttatattggagctttcggcggagggaccgaggtggtggtcaaacgt (SEQ ID NO: 752).

In another embodiment of the invention, polynucleotides of the invention comprise, or alternatively consist of, the following polynucleotide sequence encoding the constant light chain polypeptide sequence of SEQ ID NO: 750: acggtagcggccccatctgtcttcatcttcccgccatctgatgagcagttgaaatc tggaactgcctctgttgtgtgcctgctgaataa cttctatcccagagaggccaaagt acagtggaaggtggataacgccctccaatcgggtaactcccaggagagtgt cacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 760).

In a further embodiment of the invention, polynucleotides encoding antibody fragments having binding specificity to HGF comprise, or alternatively consist of, one or more of the polynucleotide sequences of SEQ ID NO: 734; SEQ ID NO: 736; and SEQ ID NO: 738, which correspond to polynucleotides encoding the complementarity-determining regions (CDRs, or hypervariable regions) of the heavy chain sequence of SEQ ID NO: 721 or the variable heavy chain sequence of SEQ ID NO: 722, and/or one or more of the polynucleotide sequences of SEQ ID NO: 754; SEQ ID NO: 756; and SEQ ID NO: 758, which correspond to the complementarity-determining regions (CDRs, or hypervariable regions) of the light chain sequence of SEQ ID NO: 741 or the variable light chain sequence of SEQ ID NO: 742, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 733; SEQ ID NO: 735; SEQ ID NO: 737; and SEQ ID NO: 739, which correspond to polynucleotides encoding the framework regions (FRs or constant regions) of the heavy chain sequence of SEQ ID NO: 721 or the variable heavy chain sequence of SEQ ID NO: 722, and/or one or more of the polynucleotide sequences of SEQ ID NO: 753; SEQ ID NO: 755; SEQ ID NO: 757; and SEQ ID NO: 759, which correspond to the framework regions (FRs or constant regions) of the light chain sequence of SEQ ID NO: 741 or the variable light chain sequence of SEQ ID NO: 742, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 731 encoding the heavy chain sequence of SEQ ID NO: 721; the polynucleotide SEQ ID NO: 732 encoding the variable heavy chain sequence of SEQ ID NO: 722; the polynucleotide SEQ ID NO: 751 encoding the light chain sequence of SEQ ID NO: 741; the polynucleotide SEQ ID NO: 752 encoding the variable light chain sequence of SEQ ID NO: 742; polynucleotides encoding the complementarity-determining regions (SEQ ID NO: 734; SEQ ID NO: 736; and SEQ ID NO: 738) of the heavy chain sequence of SEQ ID NO: 721 or the variable heavy chain sequence of SEQ ID NO: 722; polynucleotides encoding the complementarity-determining regions (SEQ ID NO: 754; SEQ ID NO: 756; and SEQ ID NO: 758) of the light chain sequence of SEQ ID NO: 741 or the variable light chain sequence of SEQ ID NO: 742; polynucleotides encoding the framework regions (SEQ ID NO: 733; SEQ ID NO: 735; SEQ ID NO: 737; and SEQ ID NO: 739) of the heavy chain sequence of SEQ ID NO: 721 or the variable heavy chain sequence of SEQ ID NO: 722; and polynucleotides encoding the framework regions (SEQ ID NO: 753; SEQ ID NO: 755; SEQ ID NO: 757; and SEQ ID NO: 759) of the light chain sequence of SEQ ID NO: 741 or the variable light chain sequence of SEQ ID NO: 742.

In a preferred embodiment of the invention, polynucleotides of the invention comprise, or alternatively consist of, polynucleotides encoding Fab (fragment antigen binding) fragments having binding specificity for HGF. With respect to antibody Ab19, the polynucleotides encoding the full length Ab19 antibody comprise, or alternatively consist of, the polynucleotide SEQ ID NO: 731 encoding the heavy chain sequence of SEQ ID NO: 721 and the polynucleotide SEQ ID NO: 751 encoding the light chain sequence of SEQ ID NO: 741.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab19 following expression of the full-length polynucleotides in a suitable host. In another embodiment of the invention, anti-HGF antibodies such as Ab19 or Fab fragments thereof may be produced via expression of Ab19 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab20

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 761: gaggtgcagaggtggagtctgggggaggcttggtccagcctggggggtccctgagactctcctgtgcagcctctggattcaccg tcagtaactattggatgggctgggtccgtcaggctccaggggaaggggctggagtggatcggaaccattagttatgatggtaacaca tactacgcgagcagcgcaaaaggccgattcaccatctccagagacaattccaagaacaccctgtatatcaaatgaacagcctgag agctgaggacactgctgtgtattactgtgctacagtcaattatcctgattatagtactggtgcctttaacatctggggccaagggaccct cgtcaccgtctcgagcgcctccaccaagggcccatcggtcttccccctggcaccctcctccaagagcacctctgggggcacagc ggccctgggctgcctggtcaaggactacttccccgaaccggtgacggtgtcgtggaactcaggcgccctgaccagcggcgtgca cacctteccggctgtcctacagtcctcaggactctactccctcagcagcgtggtgaccgtgccctccagcagcttgggcacccaga cctacatctgcaacgtgaatcacaagcccagcaacaccaaggtggacaagagagttgagcccaaatcttgtgacaaaactcacac atgcccaccgtgcccagcacctgaactcctggggggaccgtcagtcttcctcttccccccaaaacccaaggacaccctcatgatct cccgacccctgaggtcacatgcgtggtggtggacgtgagccacgaagaccctgaggtcaagttcaactggtacgtggacggcg tggaggtgcataatgccaagacaaagccgcggaggagcagtacgccagcacgtaccgtgtggtcagcgtcctcaccgtcctgca ccaggactggctgaatggcaaggagtacaagtgcaaggtctccaacaaagccctcccagccccatcgagaaaaccatctcca aagccaaagggcagccccgagaaccacaggtgtacaccctgcccccatcccgggaggagatgaccaagaaccaggtcagcct gacctgcctggtcaaaggcttctatcccagcgacatcgccgtggagtgggagagcaatgggcagccggagaacaactacaaga ccacgcctcccgtgctggactccgacggctccttcttcctctacagcaagctcaccgtggacaagagcaggtggcagcagggga acgtcttctcatgctccgtgatgcatgaggctctgcacaaccactacacgcagaagagcctctccctgtctccgggtaaa (SEQ ID NO: 771).

In another embodiment of the invention, the polynucleotides of the invention comprise, or alternatively consist of, the following polynucleotide sequence encoding the variable heavy chain polypeptide sequence of SEQ ID NO: 762: gaggtgcagaggtggagtctgggggaggcaggtccagcctggggggtccctgagactacctgtgcagcctctggattcaccg tcagtaactattggatgggctggtccgtcaggctccaggggaaggggctggagtggatcggaaccattagttatgatggtaacaca tactacgcgagcagcgcaaaaggccgattcaccataccagagacaattccaagaacaccctgtatcacaaatgaacagcctgag agctgaggacactgctgtgtattactgtgctacagtcaattatcctgattatagtactggtgccttaacatctggggccaagggaccct cgtcaccgtctcgagc (SEQ ID NO: 772).

In another embodiment of the invention, polynucleotides of the invention comprise, or alternatively consist of, the following polynucleotide sequence encoding the constant heavy chain polypeptide sequence of SEQ ID NO: 770: gcctccaccaagggcccatcggtcacccctggcacctcctccaagagcacct ctggggcacagcggccctgggctgcctg gtcaaggactacttccccgaaccggtgacggtgtcgtggaactcaggcgccctgaccagcggcgtgcacaccttc ccggctgtcc tacagtcctcaggactctactccctcagcagcgtggtgaccgt gccctccagcagcttgggcacccagacctacatctgcaacgtg aatcacaagcca gcaacaccaaggtggacaagagagttgagcccaaatcttgtgacaaaact cacacatgcccaccgtgccca gcacctgaactcctggggggaccgtcagtcttc ctcaccccccaaaacccaaggacaccctcatgatacccggacccctgaggt cacatgcgtggtggtggacgtgagccacgaagaccctgaggtcaa gttcaactggtacgtggacggcgtggaggtgcataatgc caagacaaag ccgcggaggagcagtacgccagcacgtaccgtgtggtcagcgtcctcac cgtcctgcaccaggactggctga atggcaaggagtacaagtgcaaggtctc caacaaagccctcccagccccatcgagaaaaccatctccaaagc caaagggcag ccccgagaaccacaggtgtacaccctgcccccatcccgga ggagatgaccaagaaccaggtcagcctgacctgcctggtcaa aggcttct atc cagcgacatcgccgtggagtgggagagcaatgggcagccggagaa caac tacaagaccacgcctcccgtgct ggactccgacggctccttcttcctctacagca agctcaccgtggacaagagcaggtggcagcaggggaacgtcttctcatgctccg tgatgcatgaggctctgcacaaccactacacgcagaagagcctctccctgtctc cgggtaaa (SEQ ID NO: 780).

In another embodiment of the invention, polynucleotides of the invention comprise, or alternatively consist of, the following polynucleotide sequence encoding the light chain polypeptide sequence of SEQ ID NO: 781: gacatccagat gacccagtctccatcctccctgtctgcatctgtaggagacagagtcaccatcact tgccaggccagtcagagcatt gataactacttagcctggtatcagcagaaaca gggaaagttcctaagctcctgatctattatacatccactctggcatctggggtccc atacgtttcagtggcagtggatctgggacagatttcactcaccatcagcagcct gcagcctgaagatgttgcaacttattactgtc aattcactgcttattatagtactta cattggagctttcggcggaggaaccaaggtggaaatcaaacgtacggtggctg caccatcgt cttcatcttcccgccatctgatgagcagttgaaatctggaactgc ctctgttgtgtgcctgctgaataacttctatcccagagaggccaa agtacagtg gaaggtggataacgccctccaatcgggtaactcccaggagagtgtcacagag caggacagcaaggacagcacct acagcctcagcagcacctgacgctgag caaagcagactacgagaaacacaaagtctacgcctgcgaagtcacccatca gggc ctgagctcgcccgtcacaaagagcttcaacaggggagagtgt (SEQ ID NO: 791).

In another embodiment of the invention, polynucleotides of the invention comprise, or alternatively consist of, the following polynucleotide sequence encoding the variable light chain polypeptide sequence of SEQ ID NO: 782: gacatccagatgacccagtctccatcctccctgtctgcatctgtaggagacaga gtcaccatcacttgccaggccagtcagagcatt gataactacttagcctgg tatcagcagaaaccagggaaagttcctaagctcctgatctattatacatccactctg gcatctggggtccc atctcgtttcagtggcagtggatctgggacagatttcactct caccatcagcagcctgcagcctgaagatgttgcaacttattactgtc aattcactg cttattatagtacttacattggagattcggcggaggaaccaaggtggaaat caaacgt (SEQ ID NO: 792).

In another embodiment of the invention, polynucleotides of the invention comprise, or alternatively consist of, the following polynucleotide sequence encoding the constant light chain polypeptide sequence of SEQ ID NO: 790: acggtggctgcaccatctgtcttcatcttcccgccatctgatgagcagttgaaat ctggaactgcctctgttgtgtgcctgctgaataac ttctatcccagagaggcc aaagtacagtggaaggtggataacgccctccaatcgggtaactcccaggaga gtgtcacagagcag gacagcaaggacagcacctacagcctcagcagcac cctgacgctgagcaaagcagactacgagaaacacaaagtctacgcctg cgaagtcacccatcagggcctgagctcgcccgtcacaaagagcttcaaca ggggagagtgt (SEQ ID NO: 800).

In a further embodiment of the invention, polynucleotides encoding antibody fragments having binding specificity to HGF comprise, or alternatively consist of, one or more of the polynucleotide sequences of SEQ ID NO: 774; SEQ ID NO: 776; and SEQ ID NO: 778, which correspond to polynucleotides encoding the complementarity-determining regions (CDRs, or hypervariable regions) of the heavy chain sequence of SEQ ID NO: 761 or the variable heavy chain sequence of SEQ ID NO: 762, and/or one or more of the polynucleotide sequences of SEQ ID NO: 794; SEQ ID NO: 796; and SEQ ID NO: 798, which correspond to the complementarity-determining regions (CDRs, or hypervariable regions) of the light chain sequence of SEQ ID NO: 781 or the variable light chain sequence of SEQ ID NO: 782, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 773; SEQ ID NO: 775; SEQ ID NO: 777; and SEQ ID NO: 779, which correspond to polynucleotides encoding the framework regions (FRs or constant regions) of the heavy chain sequence of SEQ ID NO: 761 or the variable heavy chain sequence of SEQ ID NO: 762, and/or one or more of the polynucleotide sequences of SEQ ID NO: 793; SEQ ID NO: 795; SEQ ID NO: 797; and SEQ ID NO: 799, which correspond to the framework regions (FRs or constant regions) of the light chain sequence of SEQ ID NO: 781 or the variable light chain sequence of SEQ ID NO: 782, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 771 encoding the heavy chain sequence of SEQ ID NO: 761; the polynucleotide SEQ ID NO: 772 encoding the variable heavy chain sequence of SEQ ID NO: 762; the polynucleotide SEQ ID NO: 791 encoding the light chain sequence of SEQ ID NO: 781; the polynucleotide SEQ ID NO: 792 encoding the variable light chain sequence of SEQ ID NO: 782; polynucleotides encoding the complementarity-determining regions (SEQ ID NO: 774; SEQ ID NO: 776; and SEQ ID NO: 778) of the heavy chain sequence of SEQ ID NO: 761 or the variable heavy chain sequence of SEQ ID NO: 762; polynucleotides encoding the complementarity-determining regions (SEQ ID NO: 794; SEQ ID NO: 796; and SEQ ID NO: 798) of the light chain sequence of SEQ ID NO: 781 or the variable light chain sequence of SEQ ID NO: 782; polynucleotides encoding the framework regions (SEQ ID NO: 773; SEQ ID NO: 775; SEQ ID NO: 777; and SEQ ID NO: 779) of the heavy chain sequence of SEQ ID NO: 761 or the variable heavy chain sequence of SEQ ID NO: 762; and polynucleotides encoding the framework regions (SEQ ID NO: 793; SEQ ID NO: 795; SEQ ID NO: 797; and SEQ ID NO: 799) of the light chain sequence of SEQ ID NO: 781 or the variable light chain sequence of SEQ ID NO: 782.

In a preferred embodiment of the invention, polynucleotides of the invention comprise, or alternatively consist of, polynucleotides encoding Fab (fragment antigen binding) fragments having binding specificity for HGF. With respect to antibody Ab20, the polynucleotides encoding the full length Ab20 antibody comprise, or alternatively consist of, the polynucleotide SEQ ID NO: 771 encoding the heavy chain sequence of SEQ ID NO: 761 and the polynucleotide SEQ ID NO: 791 encoding the light chain sequence of SEQ ID NO: 781.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab20 following expression of the full-length polynucleotides in a suitable host. In another embodiment of the invention, anti-HGF antibodies such as Ab20 or Fab fragments thereof may be produced via expression of Ab20 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab21

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 801: cagtcggtggaggagtccgggggtcgcctggtcacgcctgggacacccctgacactcacctgcaccgtctctggattctccctca gtacctactacatgagctgggtccgccaggctccagggaaggggctggaatggatcggaatcatttatgttagtggtatcacggact acgcgaggtgggcgaaaggccgattcac cataccaaaacctcgaccacggtggatctgaaaatgaccagtctgacaaccgagg acacggccacctatttctgtgccagacatattgatagtagtggctgggatggactgggcatctggggccaaggcaccctcgtcacc gtctcgagcgcctccaccaagggcccatcggtcttcccctggcaccctcctccaagagcacctctgggggcacagcggccctgggctgcctggtcaaggactacttccccga accggtgacggtgtcgtggaactcaggcgccctgaccagcggcgtgcacaccttcc cggctgtcctacagtcctcaggactctact ccctcagcagcgtggtgaccgtgccctccagcagcttgggcacccagacctacatc tgcaacgtgaatcacaagcccagcaacac caaggtggacaagagagttgagcccaaatcttgtgacaaaactcacacatgccac cgtgcccagcacctgaactcctgggggga ccgtcagtcttcctcttccccccaaaacccaaggacaccctcatgatctcccggacc cctgaggtcacatgcgtggtggtggacgt gagccacgaagaccctgaggtcaagttcaactggtacgtggacggcgtggaggtg cataatgccaagacaaagccgcgggagg agcagtacgccagcacgtaccgtgtggtcagcgtcctcaccgtcctgcaccagga ctggctgaatggcaaggagtacaagtgc aaggtctccaacaaagccacccagcccccatcgagaaaaccatctccaaagccaa agggcagccccgagaaccacaggtgta caccctgcccccatcccgggaggagatgaccaagaaccaggtcagcctgacctgcctggtcaaaggcttctatcccagcgacat cgccgtggagtgggagagcaatgggcagccggagaacaactacaagaccacgcct cccgtgctggactccgacggctccttctt cctctacagcaagctcaccgtggacaagagcaggtggcagcagggggaacgtcttctc atgctccgtgatgcatgaggctctgcaca accactacacgcagaagagcctctccctgtctccgggtaaa (SEQ ID NO: 811).

In another embodiment of the invention, the polynucleotides of the invention comprise, or alternatively consist of, the following polynucleotide sequence encoding the variable heavy chain polypeptide sequence of SEQ ID NO: 802: cagtcggtggaggagtccgggggtcgcctggtcacgcctgggacacccctgacactcacctgcaccgtctctggattctccctca gtacctactacatgagctgggtccgccaggaccagggaaggggctggaatggatcggaatcatttatgttagtggtatcacggact acgcgaggtgggcgaaaggccgattcaccatctccaaaacctcgaccacggtggatctgaaaatgaccagtctgacaaccgagg acacggccacctatttctgtgccagacatattgatagtagtggctgggatggactgggcatctggggccaaggcaccctcgtcacc gtctcgagc (SEQ ID NO: 812).

In another embodiment of the invention, polynucleotides of the invention comprise, or alternatively consist of, the following polynucleotide sequence encoding the constant heavy chain polypeptide sequence of SEQ ID NO: 810: gcctccaccaagggcccatcggtcttcccctggcaccctcctccaagagcacctctgggggcacagcggccctgggctgcctg gtcaaggactacttccccgaaccggtgacggtgtcgtggaactcaggcgccctgaccagcggcgtgcacaccttcccggctgtcc tacagtcctcaggactctactccctcagcagcgtggtgaccgtgcccctccagcagcttgggcacccagacctacatctgcaacgtg aatcacaagcccagcaacaccaaggtggacaagagagttgagcccaaatcttgtgacaaaactcacacatgccaccgtgccca gcacctgaactcctgggggaccgtcagtctcctcttccccccaaaacccaaggacaccctcatgatctcccggacccctgaggt cacatgcgtggtggtggacgtgagccacgaagaccctgaggtcaagt tcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagccacctcccaaagcccctcccagcccccatcgagaaaaccatctccaaagccaaagggcag ccccgagaaccacaggtgta caccctgcccccatcccgggaggagatgaccaagaaccaggtcagcctgacctgcctggtcaa aggcttctatcccagcgacatcgccgtggagtgggagagcaatgggcagccggagaacaactacaagaccacgcct cccgtgct ggactccgacggctccttcttcctctacagcaagctcaccgtggacaagagcaggtggcagcaggggaacgtcttctcatgctccg tgatgcatgaggctctgcacaaccactacacgcagaagagcctctccctgtctccgggtaaa (SEQ ID NO: 820).

In another embodiment of the invention, polynucleotides of the invention comprise, or alternatively consist of, the following polynucleotide sequence encoding the light chain polypeptide sequence of SEQ ID NO: 821: gcctatgatatgacccagactccagcctctgtggaggtagctgtgggaggcacagtcaccatcaagtgccaggccagtgagagca ttagtagctacttaaactggtatcagcagaaactagggcagcctcccaagctcctgatctacagggcatccactctgacatctggggt ctcatcaaggttcaaaggcagtggatctgggacagagtacactctcaccatcagcgacctggagtgtgccgatgctgccacttacta ctgtcagcagacttatggttatagtgatactgataattattcggcggagggaccgaggtggtggtcaaacgtacggtagcggcccc atctgtcttcatcttcccgccatctgatgagcagttgaaatctggaactgcctctgttgtgtgcctgctgaataacttctatcccagagag gccaaagtacagtggaaggtggataacgccctccaatcgggtaactcccaggagagtgtcacagagcaggacagcaaggacag cacctacagcctcagcagcaccctgacgctgagcaaagcagactacgagaaacacaaagtctacgcctgcgaagtcacccatca gggcctgagctcgcccgtcacaaagagcttcaacaggggagagtgt (SEQ ID NO: 831).

In another embodiment of the invention, polynucleotides of the invention comprise, or alternatively consist of, the following polynucleotide sequence encoding the variable light chain polypeptide sequence of SEQ ID NO: 822: gcctatgatatgacccagactccagcctctgtggaggtagctgtgggaggcacagtcaccatcaagtgccaggccagtgagagca ttagtagctacttaaactggtatcagcagaaactagggcagcctcccaagacctgatctacagggcatccactctgacatctggggt ctcatcaaggttcaaaggcagtggatctgggacagagtacactctcaccatcagcgacctggagtgtgccgatgctgccacttacta ctgtcagcagacttatggttatagtgatactgataattctttcggcggagggaccgaggtggtggtcaaacgt (SEQ ID NO: 832).

In another embodiment of the invention, polynucleotides of the invention comprise, or alternatively consist of, the following polynucleotide sequence encoding the constant light chain polypeptide sequence of SEQ ID NO: 830: acggtagcggcccccatctgtcttcatcttcccgccatctgatgagcagttgaaatctggaactgcctctgttgtgtgcctgctgaataa cttctatcccagagaggccaaagtacagtggaaggtggataacgccctccaatcgggtaactcccaggagagtgtcacagagca ggacagcaaggacagcacctacagcctcagcagcaccctgacgctgagcaaagcagactacgagaaacacaaagtctacgcct gcgaagtcacccatcagggcctgagctcgcccgtcacaaagagcttcaacaggggagagtgt (SEQ ID NO: 840).

In a further embodiment of the invention, polynucleotides encoding antibody fragments having binding specificity to HGF comprise, or alternatively consist of, one or more of the polynucleotide sequences of SEQ ID NO: 814; SEQ ID NO: 816; and SEQ ID NO: 818, which correspond to polynucleotides encoding the complementarity-determining regions (CDRs, or hypervariable regions) of the heavy chain sequence of SEQ ID NO: 801 or the variable heavy chain sequence of SEQ ID NO: 802, and/or one or more of the polynucleotide sequences of SEQ ID NO: 834; SEQ ID NO: 836; and SEQ ID NO: 838, which correspond to the complementarity-determining regions (CDRs, or hypervariable regions) of the light chain sequence of SEQ ID NO: 821 or the variable light chain sequence of SEQ ID NO: 822, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 813; SEQ ID NO: 815; SEQ ID NO: 817; and SEQ ID NO: 819, which correspond to polynucleotides encoding the framework regions (FRs or constant regions) of the heavy chain sequence of SEQ ID NO: 801 or the variable heavy chain sequence of SEQ ID NO: 802, and/or one or more of the polynucleotide sequences of SEQ ID NO: 833; SEQ ID NO: 835; SEQ ID NO: 837; and SEQ ID NO: 839, which correspond to the framework regions (FRs or constant regions) of the light chain sequence of SEQ ID NO: 821 or the variable light chain sequence of SEQ ID NO: 822, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 811 encoding the heavy chain sequence of SEQ ID NO: 801; the polynucleotide SEQ ID NO: 812 encoding the variable heavy chain sequence of SEQ ID NO: 802; the polynucleotide SEQ ID NO: 831 encoding the light chain sequence of SEQ ID NO: 821; the polynucleotide SEQ ID NO: 832 encoding the variable light chain sequence of SEQ ID NO: 822; polynucleotides encoding the complementarity-determining regions (SEQ ID NO: 814; SEQ ID NO: 816; and SEQ ID NO: 818) of the heavy chain sequence of SEQ ID NO: 801 or the variable heavy chain sequence of SEQ ID NO: 802; polynucleotides encoding the complementarity-determining regions (SEQ ID NO: 834; SEQ ID NO: 836; and SEQ ID NO: 838) of the light chain sequence of SEQ ID NO: 821 or the variable light chain sequence of SEQ ID NO: 822; polynucleotides encoding the framework regions (SEQ ID NO: 813; SEQ ID NO: 815; SEQ ID NO: 817; and SEQ ID NO: 819) of the heavy chain sequence of SEQ ID NO: 801 or the variable heavy chain sequence of SEQ ID NO: 802; and polynucleotides encoding the framework regions (SEQ ID NO: 833; SEQ ID NO: 835; SEQ ID NO: 837; and SEQ ID NO: 839) of the light chain sequence of SEQ ID NO: 821 or the variable light chain sequence of SEQ ID NO: 822.

In a preferred embodiment of the invention, polynucleotides of the invention comprise, or alternatively consist of, polynucleotides encoding Fab (fragment antigen binding) fragments having binding specificity for HGF. With respect to antibody Ab21, the polynucleotides encoding the full length Ab21 antibody comprise, or alternatively consist of, the polynucleotide SEQ ID NO: 811 encoding the heavy chain sequence of SEQ ID NO: 801 and the polynucleotide SEQ ID NO: 831 encoding the light chain sequence of SEQ ID NO: 821.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab21 following expression of the full-length polynucleotides in a suitable host. In another embodiment of the invention, anti-HGF antibodies such as Ab21 or Fab fragments thereof may be produced via expression of Ab21 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab23

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 841: cagtcgctggaggagtccggggtcgcctggtcacgcctggga-caccctgacactcacctgcacagcctctggattcactatcg gtcgctactac-atgagctgggtccgccaggctccagggaagggctggaatggatcggaat-catttatactcatggtgttaaccca gactacgcgagctgggcgaaaggccgat-tcaccatctccagaccctcgaccacggtggatctgaaaatcaccagtccga-caacc gaggacacggccacctatttctgtgccagagtgggtggttttaatgac-tactctgacatttggggcccaggcaccctggtcaccgtct cgagcgcct- ccac-caagggcccatcggtcttccccctggcaccctcctccaagagcacctctg-ggggcacagcggccctgggct gcctggtcaaggactacttccccgaaccggt-gacggtgtcgtggaactcaggcgccctgaccagcggcgtgcacaccttcccgg ctgtcctacagtcctcaggactctactccctcagcagcgtggtgaccgtgccac-cagcagcttgggcacccagacctacatctgca acgtgaatcacaagcccag-caacaccaaggtggacaagagagttgagcccaaatcttgtgacaaaactcaca-catgcccaccgt gcccagcacctgaactcctgggggggaccgtcagtcttcct-cttccccccaaaacccaaggacaccctcatgatctcccggacccct gaggtca-catgcgtggtggtggacgtgagccacgaagaccctgaggtcaagttcaactgg-tacgtggacggcgtggaggtgcat aatgccaagacaaagccgcgggagg-agcagtacgccagcacgtaccgtgtggtcagcgtcctcaccgtcctgcaccag-gactg gctgaatggcaaggagtacaagtgcaaggtaccaacaaagccctc-ccagcccccatcgagaaaaccatctccaaagccaaagg gcagccccgagaac-cacag gtgtacaccctgcccccatcccgggaggagatgaccaagaaccag-gtcagcctgacctgcctgg tcaaaggcttctatcccagcgacatcgccgtg-gagtgggagagcaatgggcagccggagaacaactacaagaccacgcctccc gtgctggactccgacggctccttcttcctctacagcaagctcaccgtggacaag-agcaggtggcagcaggggaacgtcttctcatg ctccgtgatgcatgaggctctg-cacaaccactacacgcagaagagcctctccctgtctccgggtaaa (SEQ ID NO: 851).

In another embodiment of the invention, the polynucleotides of the invention comprise, or alternatively consist of, the following polynucleotide sequence encoding the variable heavy chain polypeptide sequence of SEQ ID NO: 842: cagtcgctggaggagtccggggtcgcctggtcacgcctgggacaccctga-cactcacctgcacagcctctggattcactatcg gtcgctactacatgagctgggtc-cgccaggctccagggaagggctggaatggatcggaatcatttatactcatggt-gttaaccca gactacgcgagctgggcgaaaggccgattcaccatctccag-accctcgaccacggtggatctgaaaatcaccagtccgacaacc gaggacacgg-ccacctatctgtgccagagtgggtggttttaatgactactctgacatttgggg-cccaggcaccctggtcaccgtct cgagc (SEQ ID NO: 852).

In another embodiment of the invention, polynucleotides of the invention comprise, or alternatively consist of, the following polynucleotide sequence encoding the constant heavy chain polypeptide sequence of SEQ ID NO: 850: gcctccaccaagggcccatcggtcttccccctggcaccctcctccaagagcacctctgggggcacagcggccctgggctgcctg gtcaaggactacttccccgaaccggtgacggtgtcgtggaactcaggcgccctgaccagcggcgtgcacaccttccggctgtcc tacagtcctcaggactctactccctcagcagcgtg- gtgaccgtgccctccagcagcttgggcacccagacctacatctgcaacgtg aatcacaagcccagcaacaccaaggtggacaagagagttgagcccaaatcttgtgacaaa-actcacacatgcccaccgtgccca gcacctgaactcctgggggggaccgtcagtcttcctcttcccccaaaacccaaggacaccctcatgatctcccggacccct-gaggt cacatgcgtggtggtggacgtgagccacgaagaccctgaggtcaagttcaactggtacgtggacggcgtggaggtgcataatgc caagacaaagccgcgggaggagcagtacgccagcacgtaccgtgtggtcagcgtcctcaccgtcctgcaccaggactggctga atggcaaggagtacaagtgcaaggtctccaacaaagccctcccagcccccatcgagaaaaccatctccaaagc-caaagggcag ccccgagaaccacaggtgtacaccctgccccat-cccgggaggagatgaccaagaaccaggtcagcctgacctgcctggtcaa aggcttctatcccagcgacatcgccgtggagtgggagagcaatgggcagccg-gagaacaactacaagaccacgcctcccgtgct ggactccgac ggctccttcttc-ctctacagcaagctcaccgtggacaagagcaggtggcagcaggggaacgtct-tctcatgctccg tgatgcatgaggctctgcacaaccactacacgcagaagagc-ctctccctgtctccgggtaaa (SEQ ID NO: 860).

In another embodiment of the invention, polynucleotides of the invention comprise, or alternatively consist of, the following polynucleotide sequence encoding the light chain polypeptide sequence of SEQ ID NO: 861: gcctatgatatgac-ccagactccagcctctgtggaggtagagtgggaggcacagtcaccatcaagtgc-caggccagtgagagca ttagtacctacttagcctggtatcagcagaaacca-gggcagcctcccaagctcctgatctacagggcatccactctggcatctgggg tct-catcgcggttcaaaggcagtggatctgggacacagttcactctcaccatcagcg-gcgtggagtgtgccgatgctgccacttact actgtcaacagggttatagttatag-taatgttg ataatgctttcggcggagggaccgaggtggtgtcaaacgtacgg-tagcggccc catctgtcttcatcttcccgccatctgatgagcagttgaaatctgga-actgcctctgttgtgtgcctgctgaataacttctatcccagaga ggccaaagta-cagtggaaggtggataacgccaccaatcgggtaactcccaggagagtgtcaca-gagcaggacagcaaggaca gcacctacagcctcagcagcaccctgacgctg-agcaaagcagactacgagaaacacaaagtctacgcctgcgaagtcacccatc agggcctgagctcgcccgtcacaaagagcttcaacaggggagagtgt (SEQ ID NO: 871).

In another embodiment of the invention, polynucleotides of the invention comprise, or alternatively consist of, the following polynucleotide sequence encoding the variable light chain polypeptide sequence of SEQ ID NO: 862: gcctatgatatgacccagactccagcctctgtggaggtagctgtgggaggca-cagtcaccatcaagtgccaggccagtgagagca ttagtacctacttagcctg-gtatcagcagaaaccagggcagcctcccaagctcctgatctacagggcatccac-tctggcatctgggg tctcatcgcggttcaaaggcagtggatctgggacacagt-tcactctcaccatcagcggcgtggagtgtgccgatgctgccacttactactgt-caacagggttatagttatagtaatgttgataatgctttcggcggagggaccg-aggtggtggtcaaacgt (SEQ ID NO: 872).

In another embodiment of the invention, polynucleotides of the invention comprise, or alternatively consist of, the following polynucleotide sequence encoding the constant light chain polypeptide sequence of SEQ ID NO: 870: acggtagcggcccccatctgtcttcatcttcccgccatctgatgagcagttgaa-atctggaactgcctctgttgtgtgcctgctgaataa cttctatcccagagaggc-caaagtacagtggaaggtggataacgccaccaatcgggtaactcccagga-gagtgtcacagagca ggacagcaaggaca gcacctacagcctcagcagcac-cctgacgctgagcaaagcagactacgagaaacacaaagtctacgcct gcgaagtcacccatcagggcctgagctcgcccgtcacaaagagcttcaaca-ggggagagtgt (SEQ ID NO: 880).

In a further embodiment of the invention, polynucleotides encoding antibody fragments having binding specificity to HGF comprise, or alternatively consist of, one or more of the polynucleotide sequences of SEQ ID NO: 854; SEQ ID NO: 856; and SEQ ID NO: 858, which correspond to polynucleotides encoding the complementarity-determining regions (CDRs, or hypervariable regions) of the heavy chain sequence of SEQ ID NO: 841 or the variable heavy chain sequence of SEQ ID NO: 842, and/or one or more of the polynucleotide sequences of SEQ ID NO: 874; SEQ ID NO: 876; and SEQ ID NO: 878, which correspond to the complementarity-determining regions (CDRs, or hypervariable regions) of the light chain sequence of SEQ ID NO: 861 or the variable light chain sequence of SEQ ID NO: 862, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 853; SEQ ID NO: 855; SEQ ID NO: 857; and SEQ ID NO: 859, which correspond to polynucleotides encoding the framework regions (FRs or constant regions) of the heavy chain sequence of SEQ ID NO: 841 or the variable heavy chain sequence of SEQ ID NO: 842, and/or one or more of the polynucleotide sequences of SEQ ID NO: 873; SEQ ID NO: 875; SEQ ID NO: 877; and SEQ ID NO: 879, which correspond to the framework regions (FRs or constant regions) of the light chain sequence of SEQ ID NO: 861 or the variable light chain sequence of SEQ ID NO: 862, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 851 encoding the heavy chain sequence of SEQ ID NO: 841; the polynucleotide SEQ ID NO: 852 encoding the variable heavy chain sequence of SEQ ID NO: 842; the polynucleotide SEQ ID NO: 871 encoding the light chain sequence of SEQ ID NO: 861; the polynucleotide SEQ ID NO: 872 encoding the variable light chain sequence of SEQ ID NO: 862; polynucleotides encoding the complementarity-determining regions (SEQ ID NO: 854; SEQ ID NO: 856; and SEQ ID NO: 858) of the heavy chain sequence of SEQ ID NO: 841 or the variable heavy chain sequence of SEQ ID NO: 842; polynucleotides encoding the complementarity-determining regions (SEQ ID NO: 874; SEQ ID NO: 876; and SEQ ID NO: 878) of the light chain sequence of SEQ ID NO: 861 or the variable light chain sequence of SEQ ID NO: 862; polynucleotides encoding the framework regions (SEQ ID NO: 853; SEQ ID NO: 855; SEQ ID NO: 857; and SEQ ID NO: 859) of the heavy chain sequence of SEQ ID NO: 841 or the variable heavy chain sequence of SEQ ID NO: 842; and polynucleotides encoding the framework regions (SEQ ID NO: 873; SEQ ID NO: 875; SEQ ID NO: 877; and SEQ ID NO: 879) of the light chain sequence of SEQ ID NO: 861 or the variable light chain sequence of SEQ ID NO: 862.

In a preferred embodiment of the invention, polynucleotides of the invention comprise, or alternatively consist of, polynucleotides encoding Fab (fragment antigen binding) fragments having binding specificity for HGF. With respect to antibody Ab23, the polynucleotides encoding the full length Ab23 antibody comprise, or alternatively consist of, the polynucleotide SEQ ID NO: 851 encoding the heavy chain sequence of SEQ ID NO: 841 and the polynucleotide SEQ ID NO: 871 encoding the light chain sequence of SEQ ID NO: 861.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab23 following expression of the full-length polynucleotides in a suitable host. In another embodiment of the invention, anti-HGF antibodies such as Ab23 or Fab fragments thereof may be produced via expression of Ab23 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab24

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 881: gaggtgcagctggtggagtctgggggaggcttggtccagcctggggggtccctgagactctcctgtgcagcctctggattcaccg tcggtcgct actacatgagctgggtccgtcaggctccagggaaggggctggagtggatcggaat-catctatactcatggtgttaacc cagactacgcgagcagcgcgaaaggccgat-tcaccatctccagagacaattccaagaacaccctgtatcttcaaatgaacagcct-gagagctgaggacactgctgtgtattactgtgctagagtgggtggatcaatgacta-ctctgacatttggggccaagggaccctcgtc accgtctcgagcgcctccac-caagggcccatcggtcttcccccctggcaccctcctccaagagcacctctgggg-gcacagcggcc ctgggctgcctggtcaaggactacttccccgaaccggtgacg-gtgtcgtggaactcaggcgccctgaccagcggcgtgcacacc ttcccggctgtc-ctacagtcctcaggactctactccctcagcagcgtggtgaccgtgccctccagc-agcttgggcacccagaccta catctgcaacgtgaatcacaagcccagcaacac-caaggtggacaagagagttgagcccaaatcttgtgacaaaactcacacatgc ccaccgtgcccagcacctgaactcctgggggaccgtcagtcttcctctt-cccccaaaacccaaggacaccctcatgatctcccg gacccctgaggtcacatg-cgtggtggtggacgtgagccacgaagacctgaggtcaagttcaactggtacg-tggacggcgtgga ggtgcataatgccaagacaaagccgcgggaggagca-gtacgccagcacgtaccgtgtggtcagcgtcctcaccgtcctgcacca ggact-ggctgaatggcaaggagtacaagtgcaaggtctccaacaaagccctcccagc-ccccatcgagaaaaccatctccaaagc caaagggcagccccgagaaccacag-gtgtacaccctgcccccatcccgggaggagatgaccaagaaccaggtcagc-ctgacc tgcctggtcaaaggcttctatcccagcgacatcgccgtggagtggga-gagcaatgggcagccggagaacaactacaagaccac gcctcccgtgctg-gactccgacggctccttcttcctctacagcaagctcaccgtggacaagagc-aggtggcagcaggggaacgtc ttctcatgctccgtgatgcatgaggctctgca-caaccactacacgcagaagagcctctccctgtctccgggtaaa (SEQ ID NO: 891).

In another embodiment of the invention, the polynucleotides of the invention comprise, or alternatively consist of, the following polynucleotide sequence encoding the variable heavy chain polypeptide sequence of SEQ ID NO: 882: gaggtgcagaggtggagtctgggggaggcttggtccagcctggggggtcc-ctgagactctcctgtgcagcctctggattcaccg tcggtcgctactaca tgagctgggtccgtcaggctccagggaaggggctggagtggatcggaatcat ctatactcatggtgttaacc cagactacgcgagcagcgcgaaag gccgattcac-catctccagagacaattccaagaacaccctgtatcttcaaatgaacagcct gagagctgaggacactgctgtgtattactgtgctagagtgggtggtttcaatgac tactctgacatttggggccaagggaccctcgtc accgtctcgagc (SEQ ID NO: 892).

In another embodiment of the invention, polynucleotides of the invention comprise, or alternatively consist of, the following polynucleotide sequence encoding the constant heavy chain polypeptide sequence of SEQ ID NO: 890: gcctccaccaagggcccatcggtcttcccccctggcaccctcctccaagagc acctctggggcacagcggccctgggctgcctg gtcaaggactacttc-cccgaaccggtgacggtgtcgtggaactcaggcgccc tgaccagcggcgtgca-caccttcccggctgtcc tacagtcctcaggactctactccctcagcagcgtggt-gaccgtgcc accagcagcttgggcacccagacctacatctgcaacgtg aatcacaagcccagcaacaccaaggtggacaagagagttgagcccaaatct tgt-gacaaaactcacacatgcccaccgtgccca gcacctgaactcctgggggac-cgtcagtcttcctcttccccccaaaaccca aggacaccctcatgatctcccggac-ccctgaggt cacatgcgtggtggtggacgtgagccacgaagacctg aggtcaagttcaactggtacgtggacggcgtggaggtgcataatgc caaga-caaagccgcgggaggagcagtacgccagcacgtaccgtgtggtcag cgtcct-caccgtcctgcaccaggactggctga atggcaaggagtacaagtgcaaggtctc-caacaaagccctcccagccccca tcgagaaaaccatctccaaagccaa agggcag ccccgagaaccacaggtgtacaccctgcccccat cccgggagga-gatgaccaagaaccaggtcagcctgacctgcctggtcaa aggcttctatccca gcgacatcgccgtggagtgggagagcaatgggcagccggagaacaacta caagaccacgcctcccgtgct ggactccgacggctccttcttcctctacag-caagctcaccgtg gacaagagcaggtggcagcaggggaacgtcttctcat-gctccg tgatgcatgaggctctgcacaaccactacacgcagaagagcctctccct-gtctccgggtaaa (SEQ ID NO: 900).

In another embodiment of the invention, polynucleotides of the invention comprise, or alternatively consist of, the following polynucleotide sequence encoding the light chain polypeptide sequence of SEQ ID NO: 901: gacatccagatgac-ccagtctccatcctccctgtctgcatctgtaggagaca gagtcaccatcacttgc-caggccagtgagagcatt agtacctacttagcctggtatcagcagaaacca-gggaaagacctaag ctcctgatctatagggcatccactctggcatctggggtc ccatctcgtttcagtggcagtggatctgggacagatttcactctcaccat cagca-gcctgcagcctgaagatgagcaacttattactg tcaacagggttatagttatag-taatgttgataatgctttcggcggaggaaccaa ggtggaaatcaaacgtacggtg-gctgcaccatct gtcttcatcttcccgccatctgatgagcag ttgaaatctggaactgcctct gttgtgtgcctgctgaataacttctatcccagagag-gcc aaagtacagtggaaggtggataacgccctccaatcgggtaactcccag gagagtgtcacagagcaggacagcaaggacagcac ctacagcctcagcag-caccctgacgctgagcaaagcaga ctacgagaaacacaaagtctacgcctgc-gaagtcacccatcaggg cctgagctcgcccgtcacaaagagcttcaaca-ggggagagtgt (SEQ ID NO: 911).

In another embodiment of the invention, polynucleotides of the invention comprise, or alternatively consist of, the following polynucleotide sequence encoding the variable light chain polypeptide sequence of SEQ ID NO: 902: gacatccagatgacccagtctccatcctccctgtctgcatctgtaggagac agagt-caccatcacttgccaggccagtgagagcatt agtacctacttagcctggtatca-gcag aaaccagggaaagttcctaagctcctgatctatagggcatccactctg-gcatctggggtc ccatctcgtttcagtggcagtggatctgggacagatttca ctctcaccatcagcagcctgcagcctgaagatgttgcaacttattactg tcaaca-gggttatagttatagtaatgttgataatgctttcggcggaggaa ccaaggtg-gaaatcaaacgt (SEQ ID NO: 912).

In another embodiment of the invention, polynucleotides of the invention comprise, or alternatively consist of, the following polynucleotide sequence encoding the constant light chain polypeptide sequence of SEQ ID NO: 910: acggtggctgcaccatctgtcttcatcttcccgccatctgatgagcagttgaaatc tggaactgcctctgagtgtgcctgctgaataac ttctatcccagagaggccaaag-tacag tggaaggtggataacgccctccaatcgggtaactcccaggagagtgt-cacagagcag gacagcaaggacagcacctacagcctcagcagcaccctgac gctgagcaaagcagactacgagaaacacaaagtctacgcctg cgaagtcac-ccatcagggcctgagctcgcccgtcacaaagagcttcaacaggggagagtgt (SEQ ID NO: 920).

In a further embodiment of the invention, polynucleotides encoding antibody fragments having binding specificity to HGF comprise, or alternatively consist of, one or more of the polynucleotide sequences of SEQ ID NO: 894; SEQ ID NO: 896; and SEQ ID NO: 898, which correspond to polynucleotides encoding the complementarity-determining regions (CDRs, or hypervariable regions) of the heavy chain sequence of SEQ ID NO: 881 or the variable heavy chain sequence of SEQ ID NO: 882, and/or one or more of the polynucleotide sequences of SEQ ID NO: 914; SEQ ID NO: 916; and SEQ ID NO: 918, which correspond to the complementarity-determining regions (CDRs, or hypervariable regions) of the light chain sequence of SEQ ID NO: 901 or the variable light chain sequence of SEQ ID NO: 902, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 893; SEQ ID NO: 895; SEQ ID NO: 897; and SEQ ID NO: 899, which correspond to polynucleotides encoding the framework regions (FRs or constant regions) of the heavy chain sequence of SEQ ID NO: 881 or the variable heavy chain sequence of SEQ ID NO: 882, and/or one or more of the polynucleotide sequences of SEQ ID NO: 913; SEQ ID NO: 915; SEQ ID NO: 917; and SEQ ID NO: 919, which correspond to the framework regions (FRs or constant regions) of the light chain sequence of SEQ ID NO: 901 or the variable light chain sequence of SEQ ID NO: 902, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 891 encoding the heavy chain sequence of SEQ ID NO: 881; the polynucleotide SEQ ID NO: 892 encoding the variable heavy chain sequence of SEQ ID NO: 882; the polynucleotide SEQ ID NO: 911 encoding the light chain sequence of SEQ ID NO: 901; the polynucleotide SEQ ID NO: 912 encoding the variable light chain sequence of SEQ ID NO: 902; polynucleotides encoding the complementarity-determining regions (SEQ ID NO: 894; SEQ ID NO: 896; and SEQ ID NO: 898) of the heavy chain sequence of SEQ ID NO: 881 or the variable heavy chain sequence of SEQ ID NO: 882; polynucleotides encoding the complementarity-determining regions (SEQ ID NO: 914; SEQ ID NO: 916; and SEQ ID NO: 918) of the light chain sequence of SEQ ID NO: 901 or the variable light chain sequence of SEQ ID NO: 902; polynucleotides encoding the framework regions (SEQ ID NO: 893; SEQ ID NO: 895; SEQ ID NO: 897; and SEQ ID NO: 899) of the heavy chain sequence of SEQ ID NO: 881 or the variable heavy chain sequence of SEQ ID NO: 882; and polynucleotides encoding the framework regions (SEQ ID NO: 913; SEQ ID NO: 915; SEQ ID NO: 917; and SEQ ID NO: 919) of the light chain sequence of SEQ ID NO: 901 or the variable light chain sequence of SEQ ID NO: 902.

In a preferred embodiment of the invention, polynucleotides of the invention comprise, or alternatively consist of, polynucleotides encoding Fab (fragment antigen binding) fragments having binding specificity for HGF. With respect to antibody Ab24, the polynucleotides encoding the full length Ab24 antibody comprise, or alternatively consist of, the polynucleotide SEQ ID NO: 891 encoding the heavy chain sequence of SEQ ID NO: 881 and the polynucleotide SEQ ID NO: 911 encoding the light chain sequence of SEQ ID NO: 901.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab24 following expression of the full-length polynucleotides in a suitable host. In another embodiment of the invention, anti-HGF antibodies such as Ab24 or Fab fragments thereof may be produced via expression of Ab24 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab25

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 921: cagtcgctggaggagtccggggtcgcctggtcacgcctggga- caccctgacactcacctgcacagcctctggattctccctca gtagctatg- caatggg ctggttccgccaggctccagggaaggggctggagtggatcgca tacatnntgctagtggtagcacatact acgcgagctgggcgaaaggccgattcac- catctccaaaacctcgaccac ggtggagctgaaaatcaccagtctgacaac- cgagg acacggccacctatttctgtgccagaggtagtggtgctcgtttttc cccaactactttgccatctggggcccaggcaccctcgtcacc gtctcgagcgc- ctccaccaagggcccatcggtcttccccctggcaccc tcctccaagagcac- ctctgggggcacagcggccctg ggctgcctggtcaaggactacttccccgaac- cggtgacggtgtcgtgg aactcaggcgccctgaccagcggcgtgcacaccttcc cggctgtcctacagtcctcaggactctactccctcagcagcgtggtgaccg tgc- cctccagcagcttgggcacccagacctacatc tgcaacgtgaatcacaagccca- gcaacaccaaggtggacaagagagtt gagcccaaatcttgtgacaaaactcaca- catgcccac cgtgcccagcacctgaactcctgggggaccgtcagtcttcctctt cccccaaaacccaaggacaccctcatgatctcccggacc cctgaggtcacat- gcgtggtggtggacgtgagccacgaagaccctga ggtcaagttcaactgg- tacgtggacggcgtggaggtg cataatgccaagacaaagccgcgggag- gagcagtacgccagca cgtaccgtgtggtcagcgtcctcaccgtcctgca ccagga ctggctgaatggcaaggagtacaagtgcaaggtctccaacaaagc cctcccagccccccatcgagaaaaccataccaaagccaa agggcagcc ccga- gaaccacaggtgtacaccctgcccccatcccgggaggagatgacca agaacca- ggtcagcctgacctgc ctggtcaaaggcttctatcccagcgacatcgccgtg- gagtg ggagagcaatgggcagccggagaacaactacaagaccacgcct cccgtgctggactccgacggctccttcttcctctacagcaagctcaccgtggaca agagcaggtggcagcaggggaacgtcttctc atgctccgtgatgcatgag gctctgcacaaccactacacgcagaagagcctctccctgtctccgggtaaa (SEQ ID NO: 931).

In another embodiment of the invention, the polynucleotides of the invention comprise, or alternatively consist of, the following polynucleotide sequence encoding the variable heavy chain polypeptide sequence of SEQ ID NO: 922: cagtcgctggaggagtccgggggtcgcctggtcacgcctgggacaccctg acactcacctgcacagcctctggattctccctca gtagctatgcaatgggctgg ttccgccaggctccagggaaggggctggagtggatcgcatacattttgctagt ggtagcacatact acgcgagctgggcgaaaggccgattcaccatctccaaa acctcgaccacggtggagctgaaaatcaccagtctgacaaccgagg acacggc cacctatttctgtgccagaggtagtggtgctcgtffittccccaactactttgccatct gggcccaggcaccctcgtcacc gtctcgagc (SEQ ID NO: 932).

In another embodiment of the invention, polynucleotides of the invention comprise, or alternatively consist of, the following polynucleotide sequence encoding the constant heavy chain polypeptide sequence of SEQ ID NO: 930: gcctccaccaagggcccatcggtcttccccctggcaccctcctccaagagc acctctgggggcacagcggccctgggctgcctg gtcaaggac tacttcc ccgaaccggtgacggtgtcgtggaactcaggcgccctgaccagcg gcgtgca caccttccggctgtcc tacagtcctcaggactctactccctcagcagcgtggt gaccgtgccctccagcagcttgggcacccagacctacatctgcaacgtg aatca caagcccagcaacaccaaggtggacaagagagttgagcccaaatcttgtgac aaaactcacacatgcccaccgtgccca gcacctgaactcctgggggac cgtcagt cttcctcttccccccaaaacccaaggacaccctcatgatctcccggac ccctgaggt cacatgcgtggtggtggacgtgagccacgaagaccctga ggt caagttcaactggtacgtggacggcgtggaggtgcataatgc caaga caaagccgcgggaggagcagtacgccagcacgtaccgtgtggtcagcgtcc tcaccgtcctgcaccaggactggctga atggcaaggagtacaagtgcaaggtc tccaacaaagccacccagcccccatcgagaaaaccatctccaaagc caaagggcag ccccgagaaccacaggtgtacaccctgcccccatc ccgggag gagatgaccaagaaccaggtcagcctgacctgcctggtcaa aggcttcta tcccagcgacatcgccgtggagtgggagagcaatggcagccggagaac aac- tacaagaccacgcctcccgtgct ggactccgacggctccttcttcctctacag caagctc accgtggacaagagcaggtggcagcaggggaacgtcttctcat gctccg tgatgcatgaggctctgcacaaccactacacgc agaagagcctctccctgtctccgggtaaa (SEQ ID NO: 940).

In another embodiment of the invention, polynucleotides of the invention comprise, or alternatively consist of, the following polynucleotide sequence encoding the light chain polypeptide sequence of SEQ ID NO: 941: caagtgctgaccca gactgcatcgtccgtgtctgcagctgtgggaggcacag tcaccatcagttgcca gtccagtcagagtgttact aataacaacgacttagcctggtatcagcagaaa cca gggcagcctcccaagctcctgatctaccaggcatccaaactggcatctgg ggtcccatcgcggttcaaaggcagtggatctgggacacagttcactctcac catcagcgacctggagtgtgacgatgctgccactt actactgtcaaggcagt tatagtggtggtatttgtgctttcggcggagggac cgaggtggtggtcaaacg tacggtagcggcccat ctgtcttcatcttcccgccatctgatgagcagtt gaaatctggaactgcctctgtt gtgtgcctgctgaataacttctatcccagagagg ccaaagtacagtggaaggtggataacgccctccaatcgggtaactccagga gagtgtcacagagcaggacagcaaggacagc acctacgcctcagcagcac cctgacgctgagcaaagcagactacgaga aacacaaagtctacgcctgc gaagtcacccatcag ggcctgagctcgcccgtcacaaagagcttcaaca ggggagagtgt (SEQ ID NO: 951).

In another embodiment of the invention, polynucleotides of the invention comprise, or alternatively consist of, the following polynucleotide sequence encoding the variable light chain polypeptide sequence of SEQ ID NO: 942: caagtgctgacccagactgcatcgtccgtgtctgcagctgtgggaggcacagtc accatcagttgccagtccagtcagagtgttact aataacaacgacttagcctgg tatcagcagaaaccagggcagcctcccaagct cctgatctaccaggcatc caaactggcatctgg ggtcccatcgcggttcaaaggcagtggatctgggacaca gttcactctcacc atcagcgacctggagtgtgacgatgctgccactt actactgtcaaggcagttatagtggtggtatttgtgctttcggcggagggaccg aggtggtggtcaaacgt (SEQ ID NO: 952).

In another embodiment of the invention, polynucleotides of the invention comprise, or alternatively consist of, the following polynucleotide sequence encoding the constant light chain polypeptide sequence of SEQ ID NO: 950: acggtagcggccccatctgtcttcatcttcccgccatctgatgagcagttgaaa tctggaactgcctctgttgtgtgcctgctgaataa cttctatcccagagaggc caaagtacagtggaaggtggataacgccctccaa tcgggtaactcccagga gagtgtcacagagca ggacagcaaggacagcacctacagcctcagcagcac cctgacgctgagca aagcagactacgagaaacacaaagtctacgcct gcgaagtcacccatcagggcctgagctcgcccgtcacaaagagcttcaaca ggggagagtgt (SEQ ID NO: 960).

In a further embodiment of the invention, polynucleotides encoding antibody fragments having binding specificity to HGF comprise, or alternatively consist of, one or more of the polynucleotide sequences of SEQ ID NO: 934; SEQ ID NO: 936; and SEQ ID NO: 938, which correspond to polynucleotides encoding the complementarity-determining regions (CDRs, or hypervariable regions) of the heavy chain sequence of SEQ ID NO: 921 or the variable heavy chain sequence of SEQ ID NO: 922, and/or one or more of the polynucleotide sequences of SEQ ID NO: 954; SEQ ID NO: 956; and SEQ ID NO: 958, which correspond to the complementarity-determining regions (CDRs, or hypervariable regions) of the light chain sequence of SEQ ID NO: 941 or the variable light chain sequence of SEQ ID NO: 942, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 933; SEQ ID NO: 935; SEQ ID NO: 937; and SEQ ID NO: 939, which correspond to polynucleotides encoding the framework regions (FRs or constant regions) of the heavy chain sequence of SEQ ID NO: 921 or the variable heavy chain sequence of SEQ ID NO: 922, and/or one or more of the polynucleotide sequences of SEQ ID NO: 953; SEQ ID NO: 955; SEQ ID NO: 957; and SEQ ID NO: 959, which correspond to the framework regions (FRs or constant regions) of the light chain sequence of SEQ ID NO: 941 or the variable light chain sequence of SEQ ID NO: 942, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 931 encoding the heavy chain sequence of SEQ ID NO: 921; the polynucleotide SEQ ID NO: 932 encoding the variable heavy chain sequence of SEQ ID NO: 922; the polynucleotide SEQ ID NO: 951 encoding the light chain sequence of SEQ ID NO: 941; the polynucleotide SEQ ID NO: 952 encoding the variable light chain sequence of SEQ ID NO: 942; polynucleotides encoding the complementarity-determining regions (SEQ ID NO: 934; SEQ ID NO: 936; and SEQ ID NO: 938) of the heavy chain sequence of SEQ ID NO: 921 or the variable heavy chain sequence of SEQ ID NO: 922; polynucleotides encoding the complementarity-determining regions (SEQ ID NO: 954; SEQ ID NO: 956; and SEQ ID NO: 958) of the light chain sequence of SEQ ID NO: 941 or the variable light chain sequence of SEQ ID NO: 942; polynucleotides encoding the framework regions (SEQ ID NO: 933; SEQ ID NO: 935; SEQ ID NO: 937; and SEQ ID NO: 939) of the heavy chain sequence of SEQ ID NO: 921 or the variable heavy chain sequence of SEQ ID NO: 922; and polynucleotides encoding the framework regions (SEQ ID NO: 953; SEQ ID NO: 955; SEQ ID NO: 957; and SEQ ID NO: 959) of the light chain sequence of SEQ ID NO: 941 or the variable light chain sequence of SEQ ID NO: 942.

In a preferred embodiment of the invention, polynucleotides of the invention comprise, or alternatively consist of, polynucleotides encoding Fab (fragment antigen binding) fragments having binding specificity for HGF. With respect to antibody Ab25, the polynucleotides encoding the full length Ab25 antibody comprise, or alternatively consist of, the polynucleotide SEQ ID NO: 931 encoding the heavy chain sequence of SEQ ID NO: 921 and the polynucleotide SEQ ID NO: 951 encoding the light chain sequence of SEQ ID NO: 941.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab25 following expression of the full-length polynucleotides in a suitable host. In another embodiment of the invention, anti-HGF antibodies such as Ab25 or Fab fragments thereof may be produced via expression of Ab25 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab26

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 961: cagtcggtggaggagtccggggggtcgcctggtcacgcctggga cacccctgacactcacctgcacagtactggattctccctca gtacctatacaatga actgggtccgccaggctccaggggaaggggctggaatacatcggattcattag tagtagtagtagcatagatt atgtgagagggcgaaaggccgattcaccatctc caaaacctcgaccacggtgg atctgaaaatcaccagtccgacaaccgagga cacggccacctatttctgtgccagagatttttatgctgattatatgtggtggttggttatc cttacatctggggcccgggcaccctcgtcac cgtctcgagcgcctccac caagggcccatcggtcttcccctggcaccctcctc caagagcac ctctgggggcacagcggcct gggctgcctggtcaaggactacttcccgaac cggtgacggtgtcgtggaactc aggcgcctgaccagcggcgtgcacaccttc cccggctgtcctacagtcctcaggactctactccctcagcagcgtggtgaccgtg ccctccagcagcttgggcacccagacctaca tctgcaacgtgaatcacaagc ccagcaacaccaaggtggacaagagagttgag cccaaatcttgtgacaaaact cacacatgccc accgtgcccagcacctgaactcctgggggaccgtcagtcttc ctcacccccca aaacccaaggacaccctcatgatctcccgga ccctgaggtcacatgcgtggtggtggacgtgagccacgaagaccctgaggtc aagttcaactggtacgtggacggcgtggagg tgcataatgccaagacaaagc cgcgggaggagcagtacgccagcacgtaccg tgtggtcagcgtcctcaccgtc ctgcaccagg actggctgaatggcaaggagtacaagtgcaaggtctc caacaaagccctccca gccccatcgagaaaaccatctccaaagcca aagggcagccccgagaaccacaggtgtacaccctgcccccatcccgggagga gatgaccaagaaccaggtcagcctgacctg cctggtcaaaggcttctatcca gcgacatcgccgtggagtgggagagcaatg ggcagccggagaacaacta caagaccacgc ctcccgtgctggactccgacggctccttcttcctctacag caagctcaccgtgga caagagcaggtggcagcaggggaacgtcttc tcatgctccgtgatgcatgaggctctgcacaaccactacacgcagaagagcctc tccctgtaccgggtaaa (SEQ ID NO: 971).

In another embodiment of the invention, the polynucleotides of the invention comprise, or alternatively consist of, the following polynucleotide sequence encoding the variable heavy chain polypeptide sequence of SEQ ID NO: 962: cagtcggtggaggagtccggggggtcgcctggtcacgcctgggacaccctg acactcacctgcacagtctctggattctccctca gtacctatacaatgaactgggtc cgccaggctccagggaaggggctggaata catcggattcattagtagtagtag tagcatagatt atgtgagttgggcgaaaggccgattcaccatctccaaaacctc gaccacggtg gatctgaaaatcaccagtccgacaaccgagga cacggccacctatttctgtgccagagattttatgctgattatattggtggtggttat ccttacatctggggcccgggcaccctcgtcac cgtctcgagc (SEQ ID NO: 972).

In another embodiment of the invention, polynucleotides of the invention comprise, or alternatively consist of, the following polynucleotide sequence encoding the constant heavy chain polypeptide sequence of SEQ ID NO: 970: gcctccaccaagggcccatcggtcttccccctggcaccctcctccaagagca cctctgggggcacagcggccctgggctgcctg gtcaaggactacttccccgaac cggtgacggtgtcgtggaactcaggcgccc tgaccagcggcgtgcacaccttc ccggctgtcc tacagtcctcaggactctactccctcagcagcgtggtgaccgtgc caccagc agcttgggcacccagacctacatctgcaacgtg aatcacaagcccagcaacaccaaggtggacaagagagttgagcccaaatctt gtgacaaaactcacacatgcccaccgtgccca gcacctgaactc ctgggggggaccgtcagtcttcctcttccccccaaaacccaag gacaccctcat gatctcccgacccctgaggt cacatgcgtggtggtggacgtgagccac gaagaccctgaggtcaagttcaact ggtacgtggacggcgtggaggtgcataatgc caagacaaagccgcgggag gagcagtacgccagcacgtaccgtgtggtcag cgtcctcaccgtcctgcaccag gactggctga atggcaaggagtacaagtgcaaggtctccaacaaagccctccca gcccccat cgagaaaaccatctccaaagccaaagggcag ccccgagaaccacaggtgtacaccctgcccccatcccgggaggagatgacc aagaaccaggtcagcctgacctgcctggtcaa aggcttctatcccagcga catcgccgtggagtgggagagcaatgggcagccg gagaacaactacaagac cacgcctcccgtgct ggactccgacggctccttcttcctctacagcaagctcac cgtggacaagacag gtggcagcaggggaacgtcttctcatgctccg tgatgcatgaggctctgcacaaccactacacgcagaagagcctctccctgtctc cgggtaaa (SEQ ID NO: 980).

In another embodiment of the invention, polynucleotides of the invention comprise, or alternatively consist of, the following polynucleotide sequence encoding the light chain polypeptide sequence of SEQ ID NO: 981: gccgatgagtgat gacccagactccagcctccgtgtctgaacctgtgggagg cacagtcaccat caagtgccaggccagtcaga gcattagtagctacttatcctggtatcagca gaaaccagggcagcctcccaagc tcctgatctatggtgcatccaaactgacatctgg ggtcccatcgcggt tcaaaggcagtggatctgggacagagtacactctcaccat cagcgacctggagt gtgccgatgctgccactt actactgtcaaagcaattatgatatttatagttat gctttcggcggagggaccgag gtggtggtcaaacgtacggtagcggccccatc tgtcttcatcttcccgccatctgatgagcagttgaaatctggaactgcctctgttgtg tgcctgctgaataacttctatcccagagaggc caaagtacagtggaaggtgga taacgccctccaatcgggtaactcccaggaga gtgtcacagagcaggacag caaggacagca cctacagcctcagcagcaccctgacgctgagcaaagcagac tacgagaaacac aaagtctacgcctgcgaagtcacccatcagg gcctgagctcgcccgtcacaaagagcttcaacaggggagagtgt (SEQ ID NO: 991).

In another embodiment of the invention, polynucleotides of the invention comprise, or alternatively consist of, the following polynucleotide sequence encoding the variable light chain polypeptide sequence of SEQ ID NO: 982: gccgatgttgtgatgacccagactccagcctccgtgtctgaacctgtgggagg cacagtcaccatcaagtgccaggccagtcaga gcattagtagctacttatcctgg- tatcagcagaaaccagggcagcctcccaag ctcctgatctatggtgcatc- caaactgacatctgg ggtcccatcgcggttcaaaggcagtggatctgggaca- gagtacactctcacca tcagcgacctggagtgtgccgatgctgccactt actactgtcaaagcaattatgatatttatagttatgctttcggcggagggaccga ggtggtggtcaaacgt (SEQ ID NO: 992).

In another embodiment of the invention, polynucleotides of the invention comprise, or alternatively consist of, the following polynucleotide sequence encoding the constant light chain polypeptide sequence of SEQ ID NO: 990: acggtagcggccccatctgtcttcatcttcccgccatctgatgagcagttgaaatc tggaactgcctctgagtgtgcctgctgaataa cactatcccagagaggccaaag- tacagtggaaggtggataacgccaccaatcg ggtaactcccaggagagtgt- cacagagca ggacagcaaggacagcacctacagcctcagcagcaccct- gacgctgagcaaa gcagactacgagaaacacaaagtctacgcct gcgaagtcacccatcagggcctgagctcgcccgtcacaaagagcttcaaca- ggggagagtgt (SEQ ID NO: 1000).

In a further embodiment of the invention, polynucleotides encoding antibody fragments having binding specificity to HGF comprise, or alternatively consist of, one or more of the polynucleotide sequences of SEQ ID NO: 974; SEQ ID NO: 976; and SEQ ID NO: 978, which correspond to polynucleotides encoding the complementarity-determining regions (CDRs, or hypervariable regions) of the heavy chain sequence of SEQ ID NO: 961 or the variable heavy chain sequence of SEQ ID NO: 962, and/or one or more of the polynucleotide sequences of SEQ ID NO: 994; SEQ ID NO: 996; and SEQ ID NO: 998, which correspond to the complementarity-determining regions (CDRs, or hypervariable regions) of the light chain sequence of SEQ ID NO: 981 or the variable light chain sequence of SEQ ID NO: 982, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 973; SEQ ID NO: 975; SEQ ID NO: 977; and SEQ ID NO: 979, which correspond to polynucleotides encoding the framework regions (FRs or constant regions) of the heavy chain sequence of SEQ ID NO: 961 or the variable heavy chain sequence of SEQ ID NO: 962, and/or one or more of the polynucleotide sequences of SEQ ID NO: 993; SEQ ID NO: 995; SEQ ID NO: 997; and SEQ ID NO: 999, which correspond to the framework regions (FRs or constant regions) of the light chain sequence of SEQ ID NO: 981 or the variable light chain sequence of SEQ ID NO: 982, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 971 encoding the heavy chain sequence of SEQ ID NO: 961; the polynucleotide SEQ ID NO: 972 encoding the variable heavy chain sequence of SEQ ID NO: 962; the polynucleotide SEQ ID NO: 991 encoding the light chain sequence of SEQ ID NO: 981; the polynucleotide SEQ ID NO: 992 encoding the variable light chain sequence of SEQ ID NO: 982; polynucleotides encoding the complementarity-determining regions (SEQ ID NO: 974; SEQ ID NO: 976; and SEQ ID NO: 978) of the heavy chain sequence of SEQ ID NO: 961 or the variable heavy chain sequence of SEQ ID NO: 962; polynucleotides encoding the complementarity-determining regions (SEQ ID NO: 994; SEQ ID NO: 996; and SEQ ID NO: 998) of the light chain sequence of SEQ ID NO: 981 or the variable light chain sequence of SEQ ID NO: 982; polynucleotides encoding the framework regions (SEQ ID NO: 973; SEQ ID NO: 975; SEQ ID NO: 977; and SEQ ID NO: 979) of the heavy chain sequence of SEQ ID NO: 961 or the variable heavy chain sequence of SEQ ID NO: 962; and polynucleotides encoding the framework regions (SEQ ID NO: 993; SEQ ID NO: 995; SEQ ID NO: 997; and SEQ ID NO: 999) of the light chain sequence of SEQ ID NO: 981 or the variable light chain sequence of SEQ ID NO: 982.

In a preferred embodiment of the invention, polynucleotides of the invention comprise, or alternatively consist of, polynucleotides encoding Fab (fragment antigen binding) fragments having binding specificity for HGF. With respect to antibody Ab26, the polynucleotides encoding the full length Ab26 antibody comprise, or alternatively consist of, the polynucleotide SEQ ID NO: 971 encoding the heavy chain sequence of SEQ ID NO: 961 and the polynucleotide SEQ ID NO: 991 encoding the light chain sequence of SEQ ID NO: 981.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab26 following expression of the full-length polynucleotides in a suitable host. In another embodiment of the invention, anti-HGF antibodies such as Ab26 or Fab fragments thereof may be produced via expression of Ab26 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab27

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 1001: cagtcgttggaggagtccggggagacctggtcaagcctggag- gaaccctgacactcacctgcacagcctctggattctccttca gtgacgaccacta- catgtgctgggtccgccaggctccagggaaggggctgca gtggatcgcatg- catgtatgttggtagtagtggt gccacttattacgcgagctgggcgaaaggccgattcaccatctccaaaacctcg tcgaccacggtgactctgcaaatgaccagtct gacagccgcggacacggccacctatttctgtgcgagagatgattggactagttat tatgcgtgggggtattgggccttgtggggccc gggcaccctcgtcaccgtctc gagcgcctccaccaagggcccatcggtcttcc cctggcaccctcctccaagag cacctctggg ggcacagcggccctggctgcctggtcaaggactacttc cccgaaccggtgac ggtgtcgtggaactcaggcgccctgaccagc ggcgtgcacaccttcccggctgtcctacagtcctcaggactctactccctcagca gcgtggtgaccgtgccctccagcagcttggg cacccagacctacatctgca acgtgaatcacaagcccagcaacaccaaggtggacaagagagttgagcccaa atcttgtgacaaa actcacacatgcccaccgtgcccagcacctgaactc ctgggggggaccgtca gtcttcctcttcccccaaaacccaaggacaccct cat gatctcccggaccccctgaggtcacatgcgtggtggtggacgtgagccac gaagaccctgaggtcaagttcaactggtacgtg gacggcgtggaggtgcataat gccaagacaaagccgcgggaggagcagta cgccagcacgtaccgtgtggtca gcgtcctcac cgtcctgcaccaggactggctgaatggcaaggagtacaagtg caaggtctcc aacaaagccctcccagcccccatcgagaaaac catctccaaagccaaagggcagccccgagaaccacaggtgtacaccctgcc cccatcccgggaggagatgaccaagaaccag gtcagcctgacctgcctggt caaaggcttctatcccagcgacatcgccgtgga gtgggagagcaatgggcagc cggagaacaac tacaagaccacgcctcccgtgctggactccgacggctccttct tcctctacagc aagctcaccgtggacaagagcaggtggcagc aggggaacgtcttctcatgctccgtgatgcatgaggctctgcacaaccactaca cgcagaagagcctctccctgtctccgggtaaa (SEQ ID NO: 1011).

In another embodiment of the invention, the polynucleotides of the invention comprise, or alternatively consist of, the following polynucleotide sequence encoding the variable heavy chain polypeptide sequence of SEQ ID NO: 1002: cagtcgaggaggagtccggggagacctggtcaagcctggaggaac cctga cactcacctgcacagcctctggattctcatca gtgacgaccactacatgt gctgggtccgccaggctccagggaaggggctgca gtggatcgcatgcatgtat gttggtagtagtggt
gccacttattacgcgagctgggcgaaaggccgattcaccatctccaaaacctcg tcgaccacggtgactctgcaaatgaccagtct gacagccgcggacacggccac ctatttctgtgcgagagatgattggactagtta ttatgcgtgggggtattgggcca gtggggccc gggcaccctcgtcaccgtctcgagc (SEQ ID NO: 1012).

In another embodiment of the invention, polynucleotides of the invention comprise, or alternatively consist of, the following polynucleotide sequence encoding the constant heavy chain polypeptide sequence of SEQ ID NO: 1010: gcctccaccaagggcccatcggtcttcccctggcaccctcctccaagagcac ctctgggggcacagcggccctgggctgcctg gtcaaggactacttccccgaac cggtgacggtgtcgtggaactcaggcgccct gaccagcggcgtgcacaccttc ccggctgtcc tacagtcctcaggactctactccctcagcagcgtggtgaccgtgc caccagca gcttgggcacccagacctacatctgcaacgtg aatcacaagcccagcaacaccaaggtggacaagagagttgagcccaaatctt gtgacaaaactcacacatgcccaccgtgccca gcacctgaactc ctgggggggaccgtcagtatcctcttcccccaaaacccaag gacaccctcat gatctcccggaccccctgaggt cacatgcgtggtggtggacgtgagccac gaagaccctgaggtcaagttcaa ctggtacgtggacggcgtggaggtgcataatgc caagacaaagccgcgggag gagcagtacgccagcacgtaccgtgtggtca gcgtcctcaccgtcctgcaccag gactggctga atggcaaggagtacaagtgcaaggtctccaacaaagccctccca gccccat cgagaaaccatctccaaagccaaagggcag ccccgagaaccacaggtgtacaccctgccccccatcccgggaggagatgac caagaaccaggtcagcctgacctgcctggtcaa aggcttctatcccagcga catcgccgtggagtgggagagcaatgggcagcc ggagaacaactacaagac cacgcctcccgtgct ggactccgacggctccttcttcctctacagcaagctcac cgtggacaagagca ggtggcagcaggggaacgtcttctcatgctccg tgatgcatgaggctctgcacaaccactacacgcagaagagcctctccctgtctc cgggtaaa (SEQ ID NO: 1020).

In another embodiment of the invention, polynucleotides of the invention comprise, or alternatively consist of, the following polynucleotide sequence encoding the light chain polypeptide sequence of SEQ ID NO: 1021: gctgacattgtgat gacccagaatccagcctccgtgtctgaacctgtggaggc acagtcaccat caagtgccaggccagtcaga gcgttaatagttggttatcctggtatcagca gaaaccagggcagcctcccaagtt cctgatctacaaggcatccactctggcatctgg ggtctcatcgcggt tcaaaggcagtgggattgggacagagttcactctcaccat cagcgacctggagt gtgccgatgctgccacgt actattgccaatttagtaatagtggtactatt tatgggagtggtttcggcggaggg
accgaggtggtggtcaaacgtacggtagcgg ccccatctgtcttcatatcccgc catctgatgagcagttgaaatctggaactgcct ctgttgtgtgcctgctgaataact tctatcccag agaggccaaagtacagtggaaggtggataacgccac caatcgggtaactccc aggagagtgtcacagagcaggacagcaagg acagcacctacagcctcagcagcaccctgacgctgagcaaagcagactacga gaaacacaaagtctacgcctgcgaagtcacc catcagggcctgagctcgcccgt cacaaagagcttcaacaggggagagtgt (SEQ ID NO: 1031).

In another embodiment of the invention, polynucleotides of the invention comprise, or alternatively consist of, the following polynucleotide sequence encoding the variable light chain polypeptide sequence of SEQ ID NO: 1022: gctgacattgtgatgacccagaatccagcctccgtgtctgaacctgtgggaggc acagtcaccatcaagtgccaggccagtcaga gcgttaatagttggttatcctgg tatcagcagaaaccagggcagcctcccaagtt cctgatctacaaggcatc cactctggcatctgg ggtctcatcgcggttcaaaggcagtgggattgggaca gagttcactctcaccat cagcgacctggagtgtgccgatgctgccacgt actattgccaatttagtaatagtggtactatttatgggagtggatcggcggaggg accgaggtggtggtcaaacgt (SEQ ID NO: 1032).

In another embodiment of the invention, polynucleotides of the invention comprise, or alternatively consist of, the following polynucleotide sequence encoding the constant light chain polypeptide sequence of SEQ ID NO: 1030: acggtagcggccccatctgtcttcatatcccgccatctgatgagcagttgaaat ctggaactgcctctgttgtgtgcctgctgaataa cttctatcccagagaggc caaagtacagtggaaggtggataacgccaccaat cgggtaactcccagga gagtgtcacagagca ggacagcaaggacagcacctacagcctcagcagcac cctgacgctgagcaaa gcagactacgagaaacacaaagtctacgcct gcgaagtcacccatcagggcctgagctcgcccgtcacaaagagcttcaaca ggggagagtgt (SEQ ID NO: 1040).

In a further embodiment of the invention, polynucleotides encoding antibody fragments having binding specificity to HGF comprise, or alternatively consist of, one or more of the polynucleotide sequences of SEQ ID NO: 1014; SEQ ID NO: 1016; and SEQ ID NO: 1018, which correspond to polynucleotides encoding the complementarity-determining regions (CDRs, or hypervariable regions) of the heavy chain sequence of SEQ ID NO: 1001 or the variable heavy chain sequence of SEQ ID NO: 1002, and/or one or more of the polynucleotide sequences of SEQ ID NO: 1034; SEQ ID NO: 1036; and SEQ ID NO: 1038, which correspond to the complementarity-determining regions (CDRs, or hypervariable regions) of the light chain sequence of SEQ ID NO: 1021 or the variable light chain sequence of SEQ ID NO: 1022, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 1013; SEQ ID NO: 1015; SEQ ID NO: 1017; and SEQ ID NO: 1019, which correspond to polynucleotides encoding the framework regions (FRs or constant regions) of the heavy chain sequence of SEQ ID NO: 1001 or the variable heavy chain sequence of SEQ ID NO: 1002, and/or one or more of the polynucleotide sequences of SEQ ID NO: 1033; SEQ ID NO: 1035; SEQ ID NO: 1037; and SEQ ID NO: 1039, which correspond to the framework regions (FRs or constant regions) of the light chain sequence of SEQ ID NO: 1021 or the variable light chain sequence of SEQ ID NO: 1022, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 1011 encoding the heavy chain sequence of SEQ ID NO: 1001; the polynucleotide SEQ ID NO: 1012 encoding the variable heavy chain sequence of SEQ ID NO: 1002; the polynucleotide SEQ ID NO: 1031 encoding the light chain sequence of SEQ ID NO: 1021; the polynucleotide SEQ ID NO: 1032 encoding the variable light chain sequence of SEQ ID NO: 1022; polynucleotides encoding the complementarity-determining regions (SEQ ID NO: 1014; SEQ ID NO: 1016; and SEQ ID NO: 1018) of the heavy chain sequence of SEQ ID NO: 1001 or the variable heavy chain sequence of SEQ ID NO: 1002; polynucleotides encoding the complementarity-determining regions (SEQ ID NO: 1034; SEQ ID NO: 1036; and SEQ ID NO: 1038) of the light chain sequence of SEQ ID NO: 1021 or the variable light chain sequence of SEQ ID NO: 1022; polynucleotides encoding the framework regions (SEQ ID NO: 1013; SEQ ID NO: 1015; SEQ ID NO: 1017; and SEQ ID NO: 1019) of the heavy chain sequence of SEQ ID NO: 1001 or the variable heavy chain sequence of SEQ ID NO: 1002; and polynucleotides encoding the framework regions (SEQ ID NO: 1033; SEQ ID NO: 1035; SEQ ID NO: 1037; and SEQ ID NO: 1039) of the light chain sequence of SEQ ID NO: 1021 or the variable light chain sequence of SEQ ID NO: 1022.

In a preferred embodiment of the invention, polynucleotides of the invention comprise, or alternatively consist of, polynucleotides encoding Fab (fragment antigen binding) fragments having binding specificity for HGF. With respect to antibody Ab27, the polynucleotides encoding the full length Ab27 antibody comprise, or alternatively consist of, the polynucleotide SEQ ID NO: 1011 encoding the heavy chain sequence of SEQ ID NO: 1001 and the polynucleotide SEQ ID NO: 1031 encoding the light chain sequence of SEQ ID NO: 1021.

Another embodiment of the invention contemplates these polynucleotides incorporated into an expression vector for expression in mammalian cells such as CHO, NSO, HEK-293, or in fungal, insect, or microbial systems such as yeast cells such as the yeast *Pichia*. Suitable *Pichia* species include, but are not limited to, *Pichia pastoris*. In one embodiment of the invention described herein (infra), Fab fragments may be produced by enzymatic digestion (e.g., papain) of Ab27 following expression of the full-length polynucleotides in a suitable host. In another embodiment of the invention, anti-HGF antibodies such as Ab27 or Fab fragments thereof may be produced via expression of Ab27 polynucleotides in mammalian cells such as CHO, NSO or HEK 293 cells, fungal, insect, or microbial systems such as yeast cells (for example diploid yeast such as diploid *Pichia*) and other yeast strains. Suitable *Pichia* species include, but are not limited to, *Pichia pastoris*.

Antibody Ab28

In one embodiment, the invention is further directed to polynucleotides encoding antibody polypeptides having binding specificity to HGF. In one embodiment of the invention, polynucleotides of the invention comprise, or alternatively consist of, the following polynucleotide sequence encoding the heavy chain sequence of SEQ ID NO: 1041: gaggtgcagctggtggagtctgggggaggcttggtccagc-ctgggggtcc ctgagactctcctgtgcagcctctggattcaccg tcagtag-caatgcaataagctgggtccgtcaggctccagggaaggggctgga gtgggtcg-gagtcatttatgttattggtgtcactg actacgcgagctct gcgcaaggccgattcaccat ctccagagacaattccaag aacaccctgtatct-tcaaatgaacagcctgaga gctgaggacactgctgtgtattactgtgctagagtt-tatgattctggctggaatca ctttaacttgtggggccaagggaccctcgtcac cgtctcgagcgcctccaccaagggcccatcggtatccccctggcaccctcctc caagagcacctctgggggcacagcggccct gggctgcctggtcaaggactact-tccccgaaccggtgacggtgtcgtggaact caggcgccctgaccagcggcgtg-cacaccttcccggctgtcctacagtcctcaggactctactccctcagcagcgtggt-gaccg tgcctccagcagcttgggcacccagacctaca tctgcaacgtgaatcacaagcccagcaacaccaaggtggacgcgagagttg agcccaaatcttgtgacaaaactcacacatgccc accgtgcccagcacct-gaactcctggggggaccgtcagtatcctcttcccccc aaaacccaaggacac-cctcatgatctcccgga cccctgaggtcacatgcgtggtggtggacgtgagc-cacgaagaccctgaggt caagttcaactggtacgtggacggcgtggagg tgcataatgccaagacaaagccgcgggaggagcagtacgccagcacgtac cgt-gtggtcagcgtcctcaccgtcctgcaccagg actggctgaatggcaaggagta-caagtgcaaggtctccaacaaagccctccc agccccatcgagaaaaccatctc-caaagcca aagggcagccccgagaaccacaggtgtacaccctgcccccatcccgggag gagatgaccaagaaccaggtcagcctgacctg cctggtcaaaggcttctatc-ccagcgacatcgccgtggagtgggagagcaat gggcagccggagaacaacta-caagaccacgc ctcccgtgctggactccgacggctccttcttcctctacag-caagctcaccgtgg acaagagcaggtggcagcagggggaacgtcttc tcatgctccgtgatgcatgaggctctgcacaaccactacacgcagaagagcc tctccctgtctccgggtaaa (SEQ ID NO: 1051).

In another embodiment of the invention, the polynucleotides of the invention comprise, or alternatively consist of, the following polynucleotide sequence encoding the variable heavy chain polypeptide sequence of SEQ ID NO: 1042: gaggtgcagctggtggagtctgggggaggcttggtccagc-ctgggggtccc tgagactctcctgtgcagcctctggattcaccg tcagtag-caatgcaataagctgggtccgtcaggctccagggaagggggctgga gtgggteg-gagtcatttatgttattggtgtcactg actacgcgagctctgcgcaaggccgattcaccatctccagagacaattccaaga acacctgtatcttcaaatgaacagcctgaga gctgaggacactgctgtgtat-tactgtgctagagttatgattctggctggaatc actttaacttgtggggc-caagggaccctcgtcac cgtctcgagc (SEQ ID NO: 1052).

In another embodiment of the invention, polynucleotides of the invention comprise, or alternatively consist of, the following polynucleotide sequence encoding the constant heavy chain polypeptide sequence of SEQ ID NO: 1050: gcctccaccaagggcccatcggtcttccccctggcaccctcctccaagagc acctctgggggcacagcggccctgggctgcctg gtcaaggactacttec-ccgaaccggtgacggtgtcgtggaactcaggcgccc tgaccagcggcgtgca-caccttccccggctgtcc tacagtcctcaggactctactccctcagcagcgtggt-gaccgtgccctccagc agcttgggcacccagacctacatctgcaacgtg aatcacaagcccagcaacaccaaggtggacgcgagagttgagcccaaatct tgt-gacaaaactcacacatgcccaccgtgccca gcacctgaactcctgggggac-cgtcagtcttcctcttcccccaaaacccaag gacaccctcatgatctcccggac-ccctgaggt cacatgcgtggtggtggacgtgagccacgaagaccctgaggtcaagttcaact ggtacgtggacggcgtggaggtgcataatgc caagacaaagccgcgggag-gagcagtacgccagcacgtaccgtgtggtca gcgtcctcaccgtcctgcaccag-gactggctga atggcaaggagtacaagtgcaaggtctccaacaaagccctccca gccccat cgagaaaaccatctccaaagccaaagggcag ccccgagaaccacaggtgtacaccctgcccccatcccgggaggagatgacca agaaccaggtcagcctgacctgcctggtcaa aggcttctatcccagcga-catcgccgtggagtgggagagcaatgggcagccg gagaacaactacaagccacgcctcccgtgct ggactccgacggctcatcacctctacagcaagctcaccgtggacaagagcag gtggcagcaggggaacgtatctcatgctccgtgatgcatgaggctctgcacaaccactacacgcagaagagcctctccctgtctccgggtaaa (SEQ ID NO: 1060).

In another embodiment of the invention, polynucleotides of the invention comprise, or alternatively consist of, the following polynucleotide sequence encoding the light chain polypeptide sequence of SEQ ID NO: 1061: gacatccagatgacccagtctccttccaccctgtctgcatctgtaggagacaga gtcaccatcacttgccaggccagtcagagcatt agcagttggttagcctggtatcagcagaaccaggaaaagcccctaagctcct gatctatgaagcatccaaactggcatctggagtcccatcaaggttcagcggcagtggatctggaacagaattcactctcaccatca gcagcctgcagcctgatgattttgcaacttattact gccaacaggcttatagtgttgccaatgttgataatgctttcggcggaggaaccaaggtggaaatcaaacgtacggtggctgcaccat ctgtcttcatcttcccgccatctgatgagcagttgaaatctgaactgcctctgttg tgtgcctgctgaataacttctatcccagagaggccaaagtacagtggaaggtggataacgccctccaatcgggtaactcccaggagagtgtcacagagcaggacagcaaggacagc acctacagcctcagcagcaccctgacgctgagcaaagcagactacgagaaaca caaagtctacgcctgcgaagtcacccatcag ggcctgagctcgcccgtcacaaagagcttcaacaggggagagtgt (SEQ ID NO: 1071).

In another embodiment of the invention, polynucleotides of the invention comprise, or alternatively consist of, the following polynucleotide sequence encoding the variable light chain polypeptide sequence of SEQ ID NO: 1062: gacatccagatgacccagtctccttccaccctgtctgcatctgtaggagacagag tcaccatcacttgccaggccagtcagagcatt agcagttggttagcctggtatcagcagaaccaggaaaagcccctaagctcctg atctatgaagcatccaaactggcatctggagt cccatcaaggttcagcggcagtggatctggaacagaattcactctcaccatcag cagcctgcagcctgatgattttgcaacttattactgccaacaggcttatagtgttgccaatgttgataatgattcggcggaggaaccaa ggtggaaatcaaacgt (SEQ ID NO: 1072).

In another embodiment of the invention, polynucleotides of the invention comprise, or alternatively consist of, the following polynucleotide sequence encoding the constant light chain polypeptide sequence of SEQ ID NO: 1070: acggtggctgcaccatctgtcttcatcacccgccatctgatgagcagttgaaatct ggaactgcctctgttgtgtgcctgctgaataac ttctatcccagagaggccaaagtacagtggaaggtggataacgccctccaatcg ggtaactcccaggagagtgtcacagagcag gacagcaaggacagcacctacagcctcagcagcaccctgacgctgagcaaa gcagactacgagaaacacaaagtctacgcctg cgaagtcacccatcagggcctgagctcgcccgtcacaaagagcttcaacaggggagagtgt (SEQ ID NO: 1080).

In a further embodiment of the invention, polynucleotides encoding antibody fragments having binding specificity to HGF comprise, or alternatively consist of, one or more of the polynucleotide sequences of SEQ ID NO: 1054; SEQ ID NO: 1056; and SEQ ID NO: 1058, which correspond to polynucleotides encoding the complementarity-determining regions (CDRs, or hypervariable regions) of the heavy chain sequence of SEQ ID NO: 1041 or the variable heavy chain sequence of SEQ ID NO: 1042, and/or one or more of the polynucleotide sequences of SEQ ID NO: 1074; SEQ ID NO: 1076; and SEQ ID NO: 1078, which correspond to the complementarity-determining regions (CDRs, or hypervariable regions) of the light chain sequence of SEQ ID NO: 1061 or the variable light chain sequence of SEQ ID NO: 1062, or combinations of these polynucleotide sequences. In another embodiment of the invention, the polynucleotides encoding the antibodies of the invention or fragments thereof comprise, or alternatively consist of, combinations of polynucleotides encoding one or more of the CDRs, the variable heavy chain and variable light chain sequences, and the heavy chain and light chain sequences set forth above, including all of them.

In a further embodiment of the invention, polynucleotides encoding antibody fragments having binding specificity to HGF comprise, or alternatively consist of, one or more of the polynucleotide sequences of SEQ ID NO: 1053; SEQ ID NO: 1055; SEQ ID NO: 1057; and SEQ ID NO: 1059, which correspond to polynucleotides encoding the framework regions (FRs or constant regions) of the heavy chain sequence of SEQ ID NO: 1041 or the variable heavy chain sequence of SEQ ID NO: 1042, and/or one or more of the polynucleotide sequences of SEQ ID NO: 1073; SEQ ID NO: 1075; SEQ ID NO: 1077; and SEQ ID NO: 1079, which correspond to the framework regions (FRs or constant regions) of the light chain sequence of SEQ ID NO: 1061 or the variable light chain sequence of SEQ ID NO: 1062, or combinations of these polynucleotide sequences. In another embodiment of the invention, the polynucleotides encoding the antibodies of the invention or fragments thereof comprise, or alternatively consist of, combinations of one or more of the FRs, the variable heavy chain and variable light chain sequences, and the heavy chain and light chain sequences set forth above, including all of them.

The invention also contemplates polynucleotide sequences including one or more of the polynucleotide sequences encoding antibody fragments described herein. In one embodiment of the invention, polynucleotides encoding antibody fragments having binding specificity to HGF comprise, or alternatively consist of, one, two, three or more, including all of the following polynucleotides encoding antibody fragments: the polynucleotide SEQ ID NO: 1051 encoding the heavy chain sequence of SEQ ID NO: 1041; the polynucleotide SEQ ID NO: 1052 encoding the variable heavy chain sequence of SEQ ID NO: 1042; the polynucleotide SEQ ID NO: 1071 encoding the light chain sequence of SEQ ID NO: 1061; the polynucleotide SEQ ID NO: 1072 encoding the variable light chain sequence of SEQ ID NO: 1062; polynucleotides encoding the complementarity-determining regions (SEQ ID NO: 1054; SEQ ID NO: 1056; and SEQ ID NO: 1058) of the heavy chain sequence of SEQ ID NO: 1041 or the variable heavy chain sequence of SEQ ID NO: 1042; polynucleotides encoding the complementarity-determining regions (SEQ ID NO: 1074; SEQ ID NO: 1076; and SEQ ID NO: 1078) of the light chain sequence of SEQ ID NO: 1061 or the variable light chain sequence of SEQ ID NO: 1062; polynucleotides encoding the framework regions (SEQ ID NO: 1053; SEQ ID NO: 1055; SEQ ID NO: 1057; and SEQ ID NO: 1059) of the heavy chain sequence of SEQ ID NO: 1041 or the variable heavy chain sequence of SEQ ID NO: 1042; and polynucleotides encoding the framework regions (SEQ ID NO: 1073; SEQ ID NO: 1075; SEQ ID NO: 1077; and SEQ ID NO: 1079) of the light chain sequence of SEQ ID NO: 1061 or the variable light chain sequence of SEQ ID NO: 1062.

In a preferred embodiment of the invention, polynucleotides of the invention comprise, or alternatively consist of, polynucleotides encoding Fab (fragment antigen binding) fragments having binding specificity for HGF. With respect to antibody Ab28, the polynucleotides encoding the full length Ab28 antibody comprise, or alternatively consist of, the polynucleotide SEQ ID NO: 1051 encoding the heavy chain sequence of SEQ ID NO: 1041 and the polynucleotide SEQ ID NO: 1071 encoding the light chain sequence of SEQ ID NO: 1061.

In one embodiment, the invention is directed to an isolated polynucleotide comprising a polynucleotide encoding an anti-HGF VH antibody amino acid sequence selected from SEQ ID NO: 12, SEQ ID NO: 52, SEQ ID NO: 92, SEQ ID NO: 132, SEQ ID NO: 172, SEQ ID NO: 212, SEQ ID NO: 252, SEQ ID NO: 292, SEQ ID NO: 332, SEQ ID NO: 372, SEQ ID NO: 412, SEQ ID NO: 452, SEQ ID NO: 492, SEQ ID NO: 532, SEQ ID NO: 572, SEQ ID NO: 612, SEQ ID NO: 652, SEQ ID NO: 692, SEQ ID NO: 732, SEQ ID NO: 772, SEQ ID NO: 812, SEQ ID NO: 852, SEQ ID NO: 892, SEQ ID NO: 932, SEQ ID NO: 972, SEQ ID NO: 1012, SEQ ID NO: 1052 or encoding a variant thereof wherein at least one framework residue (FR residue) has been substituted with an amino acid present at the corresponding position in a rabbit anti-HGF antibody VH polypeptide or a conservative amino acid substitution.

In another embodiment, the invention is directed to an isolated polynucleotide comprising the polynucleotide sequence encoding an anti-HGF VL antibody amino acid selected from SEQ ID NO: 32, SEQ ID NO: 72, SEQ ID NO: 112, SEQ ID NO: 152, SEQ ID NO: 192, SEQ ID NO: 232, SEQ ID NO: 272, SEQ ID NO: 312, SEQ ID NO: 352, SEQ ID NO: 392, SEQ ID NO: 432, SEQ ID NO: 472, SEQ ID NO: 512, SEQ ID NO: 552, SEQ ID NO: 592, SEQ ID NO: 632, SEQ ID NO: 672, SEQ ID NO: 712, SEQ ID NO: 752, SEQ ID NO: 792, SEQ ID NO: 832, SEQ ID NO: 872, SEQ ID NO: 912, SEQ ID NO: 952, SEQ ID NO: 992, SEQ ID NO: 1032, or SEQ ID NO: 1072, or encoding a variant thereof wherein at least one framework residue (FR residue) has been substituted with an amino acid present at the corresponding position in a rabbit anti-HGF antibody VL polypeptide or a conservative amino acid substitution.

In yet another embodiment, the invention is directed to one or more heterologous polynucleotides comprising a sequence encoding the polypeptides contained in SEQ ID NO: 2 and SEQ ID NO: 22; SEQ ID NO: 42 and SEQ ID NO: 62; SEQ ID NO: 82 and SEQ ID NO: 102; SEQ ID NO: 122 and SEQ ID NO: 142; SEQ ID NO: 162 and SEQ ID NO: 182; SEQ ID NO: 202 and SEQ ID NO: 222, SEQ ID NO: 242 and SEQ ID NO: 262; SEQ ID NO: 282 and SEQ ID NO: 302; SEQ ID NO: 322 and SEQ ID NO: 342; SEQ ID NO: 362 and SEQ ID NO: 382; SEQ ID NO: 402 and SEQ ID NO: 422; SEQ ID NO: 442 and SEQ ID NO: 462; SEQ ID NO: 482 and SEQ ID NO: 502; SEQ ID NO: 522 and SEQ ID NO: 542; SEQ ID NO: 562 and SEQ ID NO: 582; SEQ ID NO: 602 and SEQ ID NO: 622; SEQ ID NO: 642 and SEQ ID NO: 662; SEQ ID NO: 682 and SEQ ID NO: 702; SEQ ID NO: 722 and SEQ ID NO: 742; SEQ ID NO: 762 and SEQ ID NO: 782; SEQ ID NO: 802 and SEQ ID NO: 822 and SEQ ID NO: 842 and SEQ ID NO: 862; SEQ ID NO: 882 and SEQ ID NO: 902; SEQ ID NO: 922 and SEQ ID NO: 942, SEQ ID NO: 962 and SEQ ID NO: 982, SEQ ID NO: 1002 and SEQ ID NO: 1022, and SEQ ID NO: 1042 and SEQ ID NO: 1062.

In another embodiment, the invention is directed to an isolated polynucleotide that expresses a polypeptide containing at least one CDR polypeptide derived from an anti-HGF antibody according to the invention such as Ab1, Ab2, Ab7, Ab8, Ab9, Ab10, Ab12, Ab14, Ab19, Ab21, Ab23, Ab24, Ab25, and Ab28, wherein said expressed polypeptide alone specifically binds HGF or specifically binds HGF when expressed in association with another polynucleotide sequence that expresses a polypeptide containing at least one CDR polypeptide derived from an anti-HGF antibody wherein said at least one CDR is selected from those contained in the VL or VH polypeptides of SEQ ID NOS: 2, 22, 42, 62, 82, 102, 122, 142, 162, 182, 202, 222, 242, 262, 282, 302, 322, 342, 362, 382, 402, 422, 442, 462, 482, 502, 522, 542, 562, 582, 602, 622, 642, 662, 682, 702, 722, 742, 762, 782, 802, 822, 842, 862, 882, 902, 922, 942, 962, 982, 1002, 1022, 1042, and 1062. More specifically, the at least one CDR comprises SEQ ID NOS: 4, 6, 8, 24, 26, 28, 44, 46, 48, 64, 66, 68, 84, 86, 88, 104, 106, 108, 124, 126, 128, 144, 146, 148, 164, 166, 168, 184, 186, 188, 204, 206, 208, 224, 226, 228, 244, 246, 248, 264, 266, 268, 284, 286, 288, 304, 306, 308, 324, 326, 328, 344, 346, 348, 364, 366, 368, 384, 386, 388, 404, 406, 408, 424, 426, 428, 444, 446, 448, 464, 466, 468, 484, 486, 488, 504, 506, 508, 524, 526, 528, 544, 546, 548, 564, 566, 568, 584, 586, 588, 604, 606, 608, 624, 626, 628, 644, 646, 648, 664, 666, 668, 684, 686, 688, 704, 706, 708, 724, 726, 728, 744, 746, 748, 764, 766, 768, 784, 786, 788, 804, 806, 808, 824, 826, 828, 844, 846, 848, 864, 866, 884, 886, 888, 904, 906, 908, 924, 926, 928, 944, 946, or 948, 964, 966, 968, 984, 986, or 988; 1004, 1006, 1008, 1024, 1026, or 1028; 1044, 1046, 1048, 1064, 1066, or 1068.

Host cells and vectors comprising said polynucleotides are also contemplated.

The invention further contemplates vectors comprising the polynucleotide sequences encoding the variable heavy and light chain polypeptide sequences, as well as the individual complementarity-determining regions (CDRs, or hypervariable regions), as set forth herein, as well as host cells comprising said vector sequences. In one embodiment of the invention, the host cell is a yeast cell. In another embodiment of the invention, the yeast host cell belongs to the genus *Pichia*.

Anti-HGF Activity

The anti-HGF antibodies of the present invention, and fragments thereof having binding specificity to HGF, may also be described by their strength of binding or their affinity for HGF. In one embodiment of the invention, the anti-HGF antibodies of the present invention, and fragments thereof having binding specificity to HGF, bind to HGF with a dissociation constant ($K_D$) of less than or equal to $5\times10^{-7}$, $10^{-7}$, $5\times10^{-8}$, $10^{-8}$, $5\times10^{-9}$, $10^{-9}$, $5\times10^{-10}$, $10^{-10}$, $5\times10^{-11}$, $10^{-11}$, $5\times10^{-12}$, $10^{-12}$, $5\times10^{-13}$, $10^{-13}$, $5\times10^{-14}$, $10^{-14}$, $5\times10^{-15}$ or $10^{-15}$.

Preferably, the anti-HGF antibodies and fragments thereof bind HGF with a dissociation constant of less than or equal to $5\times10^{-10}$. In another embodiment of the invention, the anti-HGF antibodies of the present invention, and fragments thereof having binding specificity to HGF, bind to a linear or conformational HGF epitope.

In another embodiment of the invention, the anti-HGF antibodies of the present invention, and fragments thereof having binding specificity to HGF, bind to HGF with an off-rate of less than or equal to $10^{-4}$ $S^{-1}$, $5\times10^{-5}$ $S^{-1}$, $10^{-5}$ $S^{-1}$, $5\times10^{-6}$ $S^{-1}$, $10^{-6}$ $S^{-1}$, $5\times10^{-7}$ $S^{-1}$, or $10^{-7}$ $S^{-1}$.

In another embodiment of the invention, the anti-HGF antibodies of the present invention, and fragments thereof having binding specificity to HGF, including those having binding affinities or dissociation constants described above, inhibit or block at least one HGF-associated biological activity. The term "HGF biological activity" when used herein refers to any mitogenic, motogenic or morphogenic activity of HGF or any activities occurring as a result of HGF binding to a HGF receptor. In particular, the subject antibodies and antibody fragments may be used to inhibit or block HGF-associated cell proliferation, invasion, scattering, metastasis, angiogenesis, fibrosis, and C-met or HGF receptor activation.

The term "HGF receptor or c-met activation" refers to HGF receptor dimerization or HGF receptor-induced tyrosine kinase activity. HGF receptor activation may occur as a result of HGF binding to a HGF receptor, but may alternatively occur independent of any HGF binding to a HGF receptor. HGF biological activity may, for example, be determined in an in vitro or in vivo assay of hepatocyte growth promotion, or more preferably using 4 mBr-5 cells such as in the protocol disclosed in Example 12 infra. Adult rat hepatocytes in primary culture may be used to test the effect of HGF on hepatocyte proliferation. Alternatively, the effect of a HGF antibody antagonist according to the invention can be determined in an assay suitable for testing the ability of HGF to induce DNA synthesis in other types of cells expressing HGF receptor(s), such as mink lung cells or human mammary epithelial cells and as described in the examples infra. DNA synthesis can, for example, be assayed by measuring incorporation of $^3$H-thymidine into DNA. The effectiveness of the HGF receptor antagonist can be determined by its ability to block proliferation and incorporation of the $^3$H-thymidine into DNA. The effect of HGF antagonists can also be tested in vivo in animal models, especially tumor xenograft models as disclosed infra. Also, the effect of an anti-HGF antibody or fragment according to the invention on c-met activation may be assessed such as described in the Examples infra.

In a further embodiment of the invention, the anti-HGF activity of the anti-HGF antibodies of the present invention, and fragments thereof having binding specificity to HGF, exhibit anti-HGF activity by preventing, ameliorating or reducing the symptoms of, or alternatively treating, diseases and disorders associated with HGF. Non-limiting examples of diseases and disorders associated with HGF are set forth infra.

B-Cell Screening and Isolation

In one embodiment, the present invention contemplates the preparation and isolation of a clonal population of antigen-specific B cells that may be used for isolating at least one HGF antigen-specific cell, which can be used to produce a monoclonal antibody against HGF, which is specific to a desired HGF antigen, or a nucleic acid sequence corresponding to such an antibody. Methods of preparing and isolating said clonal population of antigen-specific B cells are taught, for example, in U.S. patent publication no. US 2007/0269868 to Carvalho-Jensen et al., the disclosure of which is herein incorporated by reference in its entirety. Methods of preparing and isolating said clonal population of antigen-specific B cells are also taught herein in the examples. Methods of "enriching" a cell population by size or density are known in the art. See, e.g., U.S. Pat. No. 5,627,052. These steps can be used in addition to enriching the cell population by antigen-specificity.

Methods of Humanizing Antibodies

In another embodiment, the present invention contemplates methods for humanizing antibody heavy and light chains. Methods for humanizing antibody heavy and light chains which may be applied to anti-HGF antibodies are taught, for example, in U.S. patent application publication no. US 2009/0022659 to Olson et al., and in U.S. Pat. No. 7,935,340 to Garcia-Martinez et al., the disclosures of each of which are herein incorporated by reference in their entireties.

Methods of Producing Antibodies and Fragments Thereof

In another embodiment, the present invention contemplates methods for producing anti-HGF antibodies and fragments thereof. Methods for producing anti-HGF antibodies and fragments thereof secreted from polyploidal, preferably diploid or tetraploid strains of mating competent yeast are taught, for example, in U.S. patent application publication no. US 2009/0022659 to Olson et al., and in U.S. Pat. No. 7,935,340 to Garcia-Martinez et al., the disclosures of each of which are herein incorporated by reference in their entireties. A preferred yeast for manufacture of antibodies is *Pichia*, and more preferably *Pichia pastoris*. However, antibodies according to the invention potentially may also be made in other yeast such as other mating competent yeast of the Saccharomycetaceae family, which includes the genera *Arxiozyma; Ascobotryozyma; Citeromyces; Debaryomyces; Dekkera; Eremothecium; Issatchenkia; Kazachstania; Kluyveromyces; Kodamaea; Lodderomyces; Pachysolen; Pichia; Saccharomyces; Saturnispora; Tetrapisispora; Torulaspora; Williopsis; and Zygosaccharomyces*. Other types of yeast potentially useful for making antibody proteins according to the invention include *Yarrowia; Rhodosporidium; Candida; Hansenula; Filobasium; Sporidiobolus; Bullera; Leucosporidium and Filobasidella*.

Other methods of producing antibodies are well known to those of ordinary skill in the art. For example, methods of producing chimeric antibodies are now well known in the art (See, for example, U.S. Pat. No. 4,816,567 to Cabilly et al.; Morrison et al., P.N.A.S. USA, 81:8651-55 (1984); Neuberger, M. S. et al., Nature, 314:268-270 (1985); Boulianne, G. L. et al., Nature, 312:643-46 (1984), the disclosures of each of which are herein incorporated by reference in their entireties).

Likewise, other methods of producing humanized antibodies are now well known in the art (See, for example, U.S. Pat. Nos. 5,530,101, 5,585,089, 5,693,762, and 6,180,370 to Queen et al; U.S. Pat. Nos. 5,225,539 and 6,548,640 to Winter; U.S. Pat. Nos. 6,054,297, 6,407,213 and 6,639,055 to Carter et al; U.S. Pat. No. 6,632,927 to Adair; Jones, P. T. et al, Nature, 321:522-525 (1986); Reichmann, L., et al, Nature, 332:323-327 (1988); Verhoeyen, M, et al, Science, 239:1534-36 (1988), the disclosures of each of which are herein incorporated by reference in their entireties).

Antibody polypeptides of the invention having HGF binding specificity may also be produced by constructing, using conventional techniques well known to those of ordinary skill in the art, an expression vector containing an operon and a DNA sequence encoding an antibody heavy chain in which the DNA sequence encoding the CDRs required for antibody specificity is derived from a non-human cell source, preferably a rabbit B-cell source, while the DNA sequence encoding the remaining parts of the antibody chain is derived from a human cell source.

A second expression vector is produced using the same conventional means well known to those of ordinary skill in the art, said expression vector containing an operon and a DNA sequence encoding an antibody light chain in which the DNA sequence encoding the CDRs required for antibody specificity is derived from a non-human cell source, preferably a rabbit B-cell source, while the DNA sequence encoding the remaining parts of the antibody chain is derived from a human cell source.

The expression vectors are transfected into a host cell by convention techniques well known to those of ordinary skill in the art to produce a transfected host cell, said transfected host cell cultured by conventional techniques well known to those of ordinary skill in the art to produce said antibody polypeptides.

The host cell may be co-transfected with the two expression vectors described above, the first expression vector containing DNA encoding an operon and a light chain-derived polypeptide and the second vector containing DNA encoding an operon and a heavy chain-derived polypeptide. The two vectors contain different selectable markers, but preferably achieve substantially equal expression of the heavy and light chain polypeptides. Alternatively, a single vector may be used, the vector including DNA encoding both the heavy and light chain polypeptides. The coding sequences for the heavy and light chains may comprise cDNA, genomic DNA, or both.

Host cells which potentially may be used to express the subject antibody polypeptides may include bacterial cells such as *E. coli*, or eukaryotic cells such as *P. pastoris*, other yeast cells, fungi, insect cells, mammalian cells, and plant cells. In one embodiment of the invention, a mammalian cell of a well-defined type may be for this purpose, such as a myeloma cell, a Chinese hamster ovary (CHO) cell line, a NSO cell line, or a HEK293 cell line.

The general methods by which the vectors may be constructed, transfection methods required to produce the host cell and culturing methods required to produce the antibody polypeptides from said host cells all include conventional techniques. Although preferably the cell line used to produce the antibody is a mammalian cell line, any other suitable cell line, such as a bacterial cell line such as an *E. coli*-derived bacterial strain, or a yeast cell line, may alternatively be used.

Similarly, once produced the antibody polypeptides may be purified according to standard procedures in the art, such as for example cross-flow filtration, ammonium sulphate precipitation, affinity column chromatography and the like.

The antibody polypeptides described herein may also be used for the design and synthesis of either peptide or non-peptide mimetics that would be useful for the same therapeutic applications as the antibody polypeptides of the invention. See, for example, Saragobi et al, Science, 253: 792-795 (1991), the contents of which is herein incorporated by reference in its entirety.

Screening Assays

The invention also includes screening assays designed to assist in the identification of diseases and disorders associated with HGF in patients exhibiting symptoms of a HGF associated disease or disorder.

In some embodiments, the antibody is used as a diagnostic tool. The antibody can be used to assay the amount of HGF present in a sample and/or subject. As will be appreciated by one of skill in the art, such antibodies need not be neutralizing antibodies. In some embodiments, the diagnostic antibody is not a neutralizing antibody. In some embodiments, the diagnostic antibody binds to a different epitope than the neutralizing antibody binds to. In some embodiments, the two antibodies do not compete with one another.

In some embodiments, the antibodies disclosed herein are used or provided in an assay kit and/or method for the detection of HGF in mammalian tissues or cells in order to screen/diagnose for a disease or disorder associated with changes in levels of HGF. The kit comprises an antibody that binds HGF and means for indicating the binding of the antibody with HGF, if present, and optionally HGF protein levels. Various means for indicating the presence of an antibody can be used. For example, fluorophores, other molecular probes, or enzymes can be linked to the antibody and the presence of the antibody can be observed in a variety of ways. The method for screening for such disorders can involve the use of the kit, or simply the use of one of the disclosed antibodies and the determination of whether the antibody binds to HGF in a sample. As will be appreciated by one of skill in the art, high or elevated levels of HGF will result in larger amounts of the antibody binding to HGF in the sample. Thus, degree of antibody binding can be used to determine how much HGF is in a sample. Subjects or samples with an amount of HGF that is greater than a predetermined amount (e.g., an amount or range that a person without a HGF related disorder would have) can be characterized as having a HGF mediated disorder. In some embodiments, the antibody is administered to a subject taking a statin, in order to determine if the statin has affected the amount of HGF in the subject.

The invention is also directed to a method of in vivo imaging which detects the presence of cells which express HGF comprising administering a diagnostically effective amount of a diagnostic composition. Said in vivo imaging is useful for the detection or imaging of HGF expressing cells or organs, for example, and can be useful as part of a planning regimen for the design of an effective cancer treatment protocol. The treatment protocol may include, for example, one or more of radiation, chemotherapy, cytokine therapy, gene therapy, and antibody therapy, as well as an anti-HGF antibody or fragment thereof.

The present invention further provides for a kit for detecting binding of an anti-HGF antibody of the invention to HGF. In particular, the kit may be used to detect the presence of a HGF specifically reactive with an anti-HGF antibody of the invention or an immunoreactive fragment thereof. The kit may also include an antibody bound to a substrate, a secondary antibody reactive with the antigen and a reagent for detecting a reaction of the secondary antibody with the antigen. Such a kit may be an ELISA kit and can comprise the substrate, primary and secondary antibodies when appropriate, and any other necessary reagents such as detectable moieties, enzyme substrates, and color reagents, for example as described herein. The diagnostic kit may also be in the form of an immunoblot kit. The diagnostic kit may also be in the form of a chemiluminescent kit (Meso Scale Discovery, Gaithersburg, Md.). The diagnostic kit may also be a lanthanide-based detection kit (PerkinElmer, San Jose, Calif.).

A skilled clinician would understand that a biological sample includes, but is not limited to, sera, plasma, urine, saliva, mucous, pleural fluid, synovial fluid and spinal fluid.

Methods of Ameliorating or Reducing Symptoms of or Treating, or Preventing, Diseases And Disorders Associated with HGF and/or the HGF/HGFR (c-Met) Interaction and/or C-met Activation The anti-HGF antibodies described herein, or fragments thereof, based on their binding and functional properties are well suited for ameliorating or reducing the symptoms of, or treating, or preventing, diseases and disorders associated with HGF including those associated with the HGF/HGF-R interaction and HGF associated c-met activation. Anti-HGF antibodies described herein, or fragments thereof, as well as combinations, can also be administered in a therapeutically effective amount to patients in need of treatment of diseases and disorders associated with HGF in the form of a pharmaceutical composition as described in greater detail below.

In one embodiment of the invention, anti-HGF antibodies described herein, or fragments thereof, are useful for ameliorating or reducing the symptoms of, or treating, or preventing, the following non-limiting listing of diseases and disorders: cancers, including ovarian cancer, breast cancer, lung cancer (small cell or non-small cell), colon and colorectal cancer, prostate cancer, pancreatic cancer, renal cancer, gastric cancer, liver cancer, bladder cancer, thyroid cancer, endometrial cancer, head-and-neck tumors, melanoma, sarcomas, leukemias; lymphomas; and brain tumors (e.g., glioblastomas), of children or adults; macular degeneration; Alzheimer's disease; and malarial infection. In a preferred embodiment, the disease is selected from a cancer or macular degeneration.

In another embodiment of the invention, the invention provides use of an anti-HGF antibody of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder. In another embodiment of the invention, the invention provides use of a nucleic acid of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder.

In another embodiment of the invention, the invention provides use of an expression vector of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder. In another embodiment of the invention, the invention provides use of a host cell of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder. In another embodiment of the invention, the invention provides the use of an article of manufacture of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder.

In another aspect, the invention provides use of a kit of the invention in the preparation of a medicament for the therapeutic and/or prophylactic treatment of a disease, such as a cancer, a tumor, a cell proliferative disorder, an immune (such as autoimmune) disorder and/or an angiogenesis-related disorder.

In a preferred embodiment of the invention, the invention provides methods and compositions useful for modulating disease states associated with dysregulation of the HGF/c-met signaling axis. The HGF/c-met signaling pathway is involved in multiple biological and physiological functions, including, e.g., cell proliferation and angiogenesis. Thus, in one aspect, the invention provides a method comprising administering to a subject an antibody of the invention. In one aspect, the invention provides a method of inhibiting c-met activated cell proliferation, said method comprising contacting a cell or tissue with an effective amount of an antibody of the invention, whereby cell proliferation associated with c-met activation is inhibited. In another aspect, the invention provides a method of treating a pathological condition associated with dysregulation of c-met activation in a subject, said method comprising administering to the subject an effective amount of an antibody of the invention, whereby said condition is treated. In another aspect, the invention provides a method of inhibiting the growth of a cell that expresses c-met or hepatocyte growth factor, or both, said method comprising contacting said cell with an antibody of the invention thereby causing an inhibition of growth of said cell. In one embodiment, the cell is contacted by HGF expressed by a different cell (e.g., through a paracrine effect). In another aspect, the invention provides a method of therapeutically treating a mammal having a cancerous tumor comprising a cell that expresses c-met or hepatocyte growth factor, or both, said method comprising administering to said mammal an effective amount of an antibody of the invention, thereby effectively treating said mammal. In one embodiment, the cell is contacted by HGF expressed by a different cell (e.g., through a paracrine effect). In another aspect, the invention provides a method for treating or preventing a cell proliferative disorder associated with increased expression or activity of c-met or hepatocyte growth, or both, said method comprising administering to a subject in need of such treatment an effective amount of an antibody of the invention, thereby effectively treating or preventing said cell proliferative disorder. In one embodiment, said proliferative disorder is cancer. In another aspect, the invention provides a method for inhibiting the growth of a cell, wherein growth of said cell is at least in part dependent upon a growth potentiating effect of c-met or hepatocyte growth factor, or both, said method comprising contacting said cell with an effective amount of an antibody of the invention, thereby inhibiting the growth of said cell. In one embodiment, the cell is contacted by HGF expressed by a different cell (e.g., through a paracrine effect).

In another aspect, the invention provides a method of therapeutically treating a tumor in a mammal, wherein the growth of said tumor is at least in part dependent upon a growth potentiating effect of c-met or hepatocyte growth factor, or both, said method comprising contacting said cell with an effective amount of an antibody of the invention, thereby effectively treating said tumor. In one embodiment, the cell is contacted by HGF expressed by a different cell (e.g., through a paracrine effect).

Methods of the invention can be used to treat any suitable pathological state wherein antagonizing HGF or the HGF/c-met interaction is therapeutically beneficial, for example, cells and/or tissues associated with dysregulation of the HGF/c-met signaling pathway. In one embodiment, a cell that is targeted in a method of the invention is a cancer cell. For example, a cancer cell can be one selected from the group consisting of a breast cancer cell, a colorectal cancer cell, a lung cancer cell, a papillary carcinoma cell (e.g., of the thyroid gland), a colon cancer cell, a pancreatic cancer cell, an ovarian cancer cell, a cervical cancer cell, a central nervous system cancer cell, an osteogenic sarcoma cell, a renal carcinoma cell, a hepatocellular carcinoma cell, a bladder cancer cell, a gastric carcinoma cell, a head and neck squamous carcinoma cell, a melanoma cell and a leukemia cell. In one embodiment, a cell that is targeted in a method of the invention is a hyperproliferative and/or hyperplastic cell. In one embodiment, a cell that is targeted in a method of the invention is a dysplastic cell. In yet another embodiment, a cell that is targeted in a method of the invention is a metastatic cell.

Methods of the invention can further comprise additional treatment steps. For example, in one embodiment, a method further comprises a step wherein a targeted cell and/or tissue (e.g., a cancer cell) is exposed to radiation treatment or a chemotherapeutic agent.

As noted, c-met activation is an important biological process the dysregulation of which leads to numerous pathological conditions. Accordingly, in one embodiment of methods of the invention, a cell that is targeted (e.g., a cancer cell) is one in which activation of c-met is enhanced as compared to a normal cell of the same tissue origin. In one embodiment, a method of the invention causes the death of a targeted cell. For example, contact with an antagonist of the invention may result in a cell's inability to signal through the c-met pathway, which results in cell death.

Dysregulation of c-met activation (and thus signaling) can result from a number of cellular changes, including, for example, overexpression of HGF (c-met's cognate ligand) and/or c-met itself. Accordingly, in some embodiments, a method of the invention comprises targeting a cell wherein c-met or hepatocyte growth factor, or both, is more abundantly expressed by said cell (e.g., a cancer cell) as compared to a normal cell of the same tissue origin. A c-met-expressing cell can be regulated by HGF from a variety of sources, i.e. in an autocrine or paracrine manner. For example, in one embodiment of methods of the invention, a targeted cell is contacted/bound by hepatocyte growth factor expressed in a different cell (e.g., via a paracrine effect). Said different cell can be of the same or of a different tissue origin. In one embodiment, a targeted cell is contacted/bound by HGF expressed by the targeted cell itself (e.g., via an autocrine effect/loop). C-met activation and/or signaling can also occur independent of ligand. Hence, in one embodiment of methods of the invention, c-met activation in a targeted cell occurs independent of ligand.

A disorder treated with an anti-HGF antibody or fragment of the invention includes any condition that would benefit from treatment with a an anti-HGF antibody or fragment or method of use thereof according to the invention. This includes chronic and acute disorders or diseases including those pathological conditions which predispose the mammal to the disorder in question. Non-limiting examples of disorders to be treated herein include malignant and benign tumors; non-leukemias and lymphoid malignancies; neuronal, glial, astrocytal, hypothalamic and other glandular, macrophagal, epithelial, stromal and blastocoelic disorders; and inflammatory, immunologic and other angiogenesis-related disorders. As noted previously, cell proliferative disorders treatable according to the invention include disorders that are associated with some degree of abnormal cell proliferation. In one embodiment, the cell proliferative disorder is cancer.

Specific examples of such cancers include squamous cell cancer, small-cell lung cancer, non-small cell lung cancer, adenocarcinoma of the lung, squamous carcinoma of the lung, cancer of the peritoneum, hepatocellular cancer, gastrointestinal cancer, pancreatic cancer, glioblastoma, cervical cancer, ovarian cancer, liver cancer, bladder cancer, hepatoma, breast cancer, colon cancer, colorectal cancer, endometrial or uterine carcinoma, salivary gland carcinoma, kidney cancer, liver cancer, prostate cancer, vulval cancer, thyroid cancer, hepatic carcinoma and various types of head and neck cancer.

Another type of disorder that may be treated with an anti-HGF antibody or fragment of the invention includes those involving dysregulation of angiogenesis. These disorders include both non-neoplastic and neoplastic conditions. Neoplastics include but are not limited those cancers d above. Non-neoplastic disorders include but are not limited to undesired or aberrant hypertrophy, arthritis, rheumatoid arthritis (RA), psoriasis, psoriatic plaques, sarcoidosis, atherosclerosis, atherosclerotic plaques, diabetic and other proliferative retinopathies including retinopathy of prematurity, retrolental fibroplasia, neovascular glaucoma, age-related macular degeneration, diabetic macular edema, corneal neovascularization, corneal graft neovascularization, corneal graft rejection, retinal/choroidal neovascularization, neovascularization of the angle (rubeosis), ocular neovascular disease, vascular restenosis, arteriovenous malformations (AVM), meningioma, hemangioma, angiofibroma, thyroid hyperplasias (including Grave's disease), corneal and other tissue transplantation, chronic inflammation, lung inflammation, acute lung injury/ARDS, sepsis, primary pulmonary hypertension, malignant pulmonary effusions, cerebral edema (e.g., associated with acute stroke/closed head injury/trauma), synovial inflammation, pannus formation in RA, myositis ossificans, hypertropic bone formation, osteoarthritis (OA), refractory ascites, polycystic ovarian disease, endometriosis, 3rd spacing of fluid diseases (pancreatitis, compartment syndrome, burns, bowel disease), uterine fibroids, premature labor, chronic inflammation such as IBD (Crohn's disease and ulcerative colitis), renal allograft rejection, inflammatory bowel disease, nephrotic syndrome, undesired or aberrant tissue mass growth (non-cancer), hemophilic joints, hypertrophic scars, inhibition of hair growth, Osler-Weber syndrome, pyogenic granuloma retrolental fibroplasias, scleroderma, trachoma, vascular adhesions, synovitis, delimitates, preeclampsia, ascites, pericardial effusion (such as that associated with pericarditis), and pleural effusion.

In preferred embodiments, an antibody to HGF is used with one or more other therapeutic agents or regimens used to treat various cancers. In certain embodiments, an antibody to HGF is used with one or more particular therapeutic agents to treat or prevent malaria. In certain embodiments, an antibody specific to HGF is used with one or more particular therapeutic agents to treat or prevent proliferative diabetic retinopathy. In certain embodiments, in view of the condition and the desired level of treatment, two, three, or more agents may be administered. In certain embodiments, such agents may be provided together by inclusion in the same formulation. In certain embodiments, such agents and a specific binding agent to HGF may be provided together by inclusion in the same formulation. In certain embodiments, such agents may be formulated separately and provided together by inclusion in a treatment kit. In certain embodiments, such agents and a specific binding agent to HGF may be formulated separately and provided together by inclusion in a treatment kit. In certain embodiments, such agents may be provided separately.

Methods of the invention may be useful for ameliorating and/or treating diseases or conditions involving aberrant angiogenesis. "Aberrant angiogenesis," as used herein refers to angiogenesis that does not occur in normal biological processes such as development, reproduction, wound healing etc. Angiogenesis that may be reduced using methods of the invention may be stimulated, in some embodiments, by a factor selected from the group consisting of vascular endothelial growth factor (VEGF), basic fibroblast growth factor (bFGF), lipopolysaccharide (LPS), epidermal growth factor (EGF), interleukin-6 (IL-6), platelet-derived growth factor (PDGF), tumor necrosis factor (TNFalpha), hepatocyte growth factor (HGF), and combinations thereof.

As angiogenesis is involved in a variety of pathologic processes, itle inventive methods may be useful in treating and/or ameliorating diseases such as, for example cancer (including metastatic cancer), ocular neovascularization (such as macular degeneration), inflammatory diseases (such as arthritis), etc.

Tumors often come to depend on the formation of new blood vessels in order to continue growing and/or develop metastases. Thus, inventive methods may be useful in ameliorating and/or treating tumors. Subjects that may be administered chlorotoxin agents may have tumors that are beginning to metastasize or have already metastasized. Subjects may have one or more metastases. In some embodiments, sizes of tumors and/or metastases are reduced.

In some embodiments, the subject is suffering from or at risk for a condition or disease characterized by choroidal neovascularization. Such conditions include, but are not limited to, macular degeneration, myopia, ocular trauma, pseudoxanthoma elasticum, and combinations thereof.

Macular degeneration is the leading cause of vision loss and blindness in Americans aged 65 and older. Macular degeneration typically occurs in the age-related form (often called AMD or ARMD), though juvenile macular degeneration occurs as well. In AMD/ARMD, the macula—the part of the retina that is responsible for sharp, central vision—degenerates. Macular degeneration is typically diagnosed as either dry (non-neovascular) or wet (neovascular). In dry macular degeneration, yellowish spots known as drusen begin to accumulate from deposits or debris from deteriorating tissue from mostly around the macula. Central vision less usually occurs gradually and is not as severe as vision loss in wet macular degeneration.

Wet macular degeneration, as the "neovascular" designation suggests, is characterized by new blood vessels growing aberrantly, e.g., on the macula. Such new blood vessels may grow beneath the retina, leaking blood and fluid. Such leakage causes permanent damage to light-sensitive retinal cells, which die and create blind spots in central vision. Wet macular degeneration may be further grouped into two categories. In the occult form of wet macular degeneration, new blood vessel growth beneath the retina is not as pronounced and leakage is less evident, typically resulting in less severe vision less. In the classic form of wet macular degeneration, blood vessel growth and scarring have very clear, delineated outlines that are observable beneath the retina. Classic wet macular degeneration is also known as classic choroidal neovascularization and usually results in more severe vision loss.

Given the role of angiogenesis in wet macular degeneration, which comprises many AMD/ARMD cases, inventive methods may be useful in treating and/or ameliorating such disorders. Current therapies for wet macular degeneration involve angiogenesis inhibitors such as Lucentis™, Macugen™, and/or Visudyne™, optionally combined with photodynamic therapy (PDT) to target drugs to specific cells. Photocoagulation, in which a high energy laser beam is used to create small burns in areas of the retina with abnormal blood vessels, is also used to treat wet macular degeneration.

In some embodiments, the subject suffers from wet macular degeneration and/or age-related macular degeneration. Among subjects suffering from wet macular degeneration, subjects may suffer from the occult or the classic form. In some embodiments, chlorotoxin agents cause regression of existing neovasculature. In some embodiments, chlorotoxin agents prevent sprouting of new vessels. In certain embodiments, chlorotoxin agents are combined with other treatments for wet macular degeneration, such as photocoagulation, treatment with other angiogenesis inhibitors, photodynamic therapy, etc.

The foregoing is intended to be exemplary of diseases and conditions wherein administration of an anti-HGF antibody or fragment according to the invention may be therapeutically beneficial.

Administration

In one embodiment of the invention, the anti-HGF antibodies described herein, or HGF binding fragments thereof, as well as combinations of said antibodies or antibody fragments, are administered to a subject at a concentration of between about 0.1 and 10.0 mg/kg of body weight of recipient subject. In a preferred embodiment of the invention, the anti-HGF antibodies described herein, or HGF binding fragments thereof, as well as combinations of said antibodies or antibody fragments, are administered to a subject at a concentration of about 0.4 mg/kg of body weight of recipient subject. In a preferred embodiment of the invention, the anti-HGF antibodies described herein, or HGF binding fragments thereof, as well as combinations of said antibodies or antibody fragments, are administered to a recipient subject with a frequency of once every twenty-six weeks or less, such as once every sixteen weeks or less, once every eight weeks or less, or once every four weeks or less.

A person of skill in the art would be able to determine an effective dosage and frequency of administration through routine experimentation, for example guided by the disclosure herein and the teachings in Goodman, L. S., Gilman, A., Brunton, L. L., Lazo, J. S., & Parker, K. L. (2006). Goodman & Gilman's the pharmacological basis of therapeutics. New York: McGraw-Hill; Howland, R. D., Mycek, M. J., Harvey, R. A., Champe, P. C., & Mycek, M. J. (2006). Pharmacology. Lippincott's illustrated reviews. Philadelphia: Lippincott Williams & Wilkins; and Golan, D. E. (2008). Principles of pharmacology: the pathophysiologic basis of drug therapy. Philadelphia, Pa., [etc.]: Lippincott Williams & Wilkins.

In another embodiment of the invention, the anti-HGF antibodies described herein, or HGF binding fragments thereof, as well as combinations of said antibodies or antibody fragments, are administered to a subject in a pharmaceutical formulation.

A "pharmaceutical composition" refers to a chemical or biological composition suitable for administration to a mammal. Such compositions may be specifically formulated for administration via one or more of a number of routes, including but not limited to buccal, epicutaneous, epidural, inhalation, intraarterial, intracardial, intracerebroventricular, intradermal, intramuscular, intranasal, intraocular, intraperitoneal, intraspinal, intrathecal, intravenous, oral, parenteral, rectally via an enema or suppository, subcutaneous, subdermal, sublingual, transdermal, and transmucosal. In addition, administration can occur by means of injection, powder, liquid, gel, drops, or other means of administration.

In one embodiment of the invention, the anti-HGF antibodies described herein, or HGF binding fragments thereof, as well as combinations of said antibodies or antibody fragments, may be optionally administered in combination with one or more active agents. Such active agents include analgesic, antipyretic, anti-inflammatory, antibiotic, antiviral, and anti-cytokine agents. Active agents include agonists, antagonists, and modulators of TNF-α, IL-2, IL-4, IL-6, IL-10, IL-12, IL-13, IL-18, IFN-α, IFN-γ, BAFF, CXCL13, IP-10, VEGF, EPO, EGF, HRG, Hepatocyte Growth Factor (HGF), Hepcidin, including antibodies reactive against any of the foregoing, and antibodies reactive against any of their receptors. Active agents also include 2-Arylpropionic acids, Aceclofenac, Acemetacin, Acetylsalicylic acid (Aspirin), Alclofenac, Alminoprofen, Amoxiprin, Ampyrone, Arylalkanoic acids, Azapropazone, Benorylate/Benorilate, Benoxaprofen, Bromfenac, Carprofen, Celecoxib, Choline magnesium salicylate, Clofezone, COX-2 inhibitors, Dexibuprofen, Dexketoprofen, Diclofenac, Diflunisal, Droxicam, Ethenzamide, Etodolac, Etoricoxib, Faislamine, fenamic acids, Fenbufen, Fenoprofen, Flufenamic acid, Flunoxaprofen, Flurbiprofen, Ibuprofen, Ibuproxam, Indometacin, Indoprofen, Kebuzone, Ketoprofen, Ketorolac, Lornoxicam, Loxoprofen, Lumiracoxib, Magnesium salicylate, Meclofenamic acid, Mefenamic acid, Meloxicam, Metamizole, Methyl salicylate, Mofebutazone, Nabumetone, Naproxen, N-Arylanthranilic acids, Oxametacin, Oxaprozin, Oxicams, Oxyphenbutazone, Parecoxib, Phenazone, Phenylbutazone, Phenylbutazone, Piroxicam, Pirprofen, profens, Proglumetacin, Pyrazolidine derivatives, Rofecoxib, Salicyl salicylate, Salicylamide, Salicylates, Sulfinpyrazone, Sulindac, Suprofen, Tenoxicam, Tiaprofenic acid, Tolfenamic acid, Tolmetin, and Valdecoxib. Antibiotics include Amikacin, Aminoglycosides, Amoxicillin, Ampicillin, Ansamycins, Arsphenamine, Azithromycin, Azlocillin, Aztreonam, Bacitracin, Carbacephem, Carbapenems, Carbenicillin, Cefaclor, Cefadroxil, Cefalexin, Cefalothin, Cefalotin, Cefamandole, Cefazolin, Cefdinir, Cefditoren, Cefepime, Cefixime, Cefoperazone, Cefotaxime, Cefoxitin, Cefpodoxime, Cefprozil, Ceftazidime, Ceftibuten, Ceftizoxime, Ceftobiprole, Ceftriaxone, Cefuroxime, Cephalosporins, Chloramphenicol, Cilastatin, Ciprofloxacin, Clarithromycin, Clindamycin, Cloxacillin, Colistin, Co-trimoxazole, Dalfopristin, Demeclocycline, Dicloxacillin, Dirithromycin, Doripenem, Doxycycline, Enoxacin, Ertapenem, Erythromycin, Ethambutol, Flucloxacillin, Fosfomycin, Furazolidone, Fusidic acid, Gatifloxacin, Geldanamycin, Gentamicin, Glycopeptides, Herbimycin, Imipenem, Isoniazid, Kanamycin, Levofloxacin, Lincomycin, Linezolid, Lomefloxacin, Loracarbef, Macrolides, Mafenide, Meropenem, Meticillin, Metronidazole, Mezlocillin, Minocycline, Monobactams, Moxifloxacin, Mupirocin, Nafcillin, Neomycin, Netilmicin, Nitrofurantoin, Norfloxacin, Ofloxacin, Oxacillin, Oxytetracycline, Paromomycin, Penicillin, Penicillins, Piperacillin, Platensimycin, Polymyxin B, Polypeptides, Prontosil, Pyrazinamide, Quinolones, Quinupristin, Rifampicin, Rifampin, Roxithromycin, Spectinomycin, Streptomycin, Sulfacetamide, Sulfamethizole, Sulfanilimide, Sulfasalazine, Sulfisoxazole, Sulfonamides, Teicoplanin, Telithromycin, Tetracycline, Tetracyclines, Ticarcillin, Timidazole, Tobramycin, Trimethoprim, Trimethoprim-Sulfamethoxazole, Troleandomycin, Trovafloxacin, and Vancomycin. Active agents also include Aldosterone, Beclometasone, Betamethasone, Corticosteroids, Cortisol, Cortisone acetate, Deoxycorticosterone acetate, Dexamethasone, Fludrocortisone acetate, Glucocorticoids, Hydrocortisone, Methylprednisolone, Prednisolone, Prednisone, Steroids, and Triamcinolone. Any suitable combination of these active agents is also contemplated.

A "pharmaceutical excipient" or a "pharmaceutically acceptable excipient" is a carrier, usually a liquid, in which an active therapeutic agent is formulated. In one embodiment of the invention, the active therapeutic agent is a humanized antibody described herein, or one or more fragments thereof. The excipient generally does not provide any pharmacological activity to the formulation, though it may provide chemical and/or biological stability, and release characteristics. Exemplary formulations can be found, for example, in Remington's Pharmaceutical Sciences, 19$^{th}$ Ed., Grennaro, A., Ed., 1995 which is incorporated by reference.

As used herein "pharmaceutically acceptable carrier" or "excipient" includes any and all solvents, dispersion media, coatings, antibacterial and antifungal agents, isotonic and absorption delaying agents that are physiologically compatible. In one embodiment, the carrier is suitable for parenteral administration. Alternatively, the carrier can be suitable for intravenous, intraperitoneal, intramuscular, or sublingual administration. Pharmaceutically acceptable carriers include sterile aqueous solutions or dispersions and sterile powders for the extemporaneous preparation of sterile injectable solutions or dispersions. The use of such media and agents for pharmaceutically active substances is well known in the art. Except insofar as any conventional media or agent is incompatible with the active compound, use thereof in the pharmaceutical compositions of the invention is contemplated. Supplementary active compounds can also be incorporated into the compositions.

Pharmaceutical compositions typically must be sterile and stable under the conditions of manufacture and storage. The invention contemplates that the pharmaceutical composition is present in lyophilized form. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol), and suitable mixtures thereof. The invention further contemplates the inclusion of a stabilizer in the pharmaceutical composition. The proper fluidity can be maintained, for example, by the use of a coating such as lecithin, by the maintenance of the required particle size in the case of dispersion and by the use of surfactants.

In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, monostearate salts and gelatin. Moreover, the alkaline polypeptide can be formulated in a time release formulation, for example in a composition which includes a slow release polymer. The active compounds can be prepared with carriers that will protect the compound against rapid release, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid and polylactic, polyglycolic copolymers (PLG). Many methods for the preparation of such formulations are known to those skilled in the art.

For each of the recited embodiments, the compounds can be administered by a variety of dosage forms. Any biologically-acceptable dosage form known to persons of ordinary skill in the art, and combinations thereof, are contemplated. Examples of such dosage forms include, without limitation, reconstitutable powders, elixirs, liquids, solutions, suspensions, emulsions, powders, granules, particles, microparticles, dispersible granules, cachets, inhalants, aerosol inhalants, patches, particle inhalants, implants, depot implants, injectables (including subcutaneous, intramuscular, intravenous, and intradermal), infusions, and combinations thereof.

The above description of various illustrated embodiments of the invention is not intended to be exhaustive or to limit the invention to the precise form disclosed. The following examples are put forth so as to further provide those of ordinary skill in the art with a complete disclosure and description of how to make and use the subject invention, and are not intended to limit the scope of what is regarded as the invention. Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight, temperature is in degrees centigrade; and pressure is at or near atmospheric.

The following examples are put forth so as to provide those of ordinary skill in the art with a complete disclosure and description of how to make and use the subject invention, and are not intended to limit the scope of what is regarded as the invention. Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight, temperature is in degrees centigrade; and pressure is at or near atmospheric.

EXAMPLES

Example 1

Production of Enriched Antigen-Specific B Cell Antibody Culture

Panels of antibodies are derived by immunizing traditional antibody host animals to exploit the native immune response to a target antigen of interest. Typically, the host used for immunization is a rabbit or other host that produces antibodies using a similar maturation process and provides for a population of antigen-specific B cells producing antibodies of comparable diversity, e.g., epitopic diversity. The initial antigen immunization can be conducted using complete Freund's adjuvant (CFA), and the subsequent boosts effected with incomplete adjuvant. At about 50-60 days after immunization, preferably at day 55, antibody titers are tested, and the Antibody Selection (ABS) process is initiated if appropriate titers are established. The two key criteria for ABS initiation are potent antigen recognition and function-modifying activity in the polyclonal sera.

Antibody Selection Titer Assessment

To identify and characterize antibodies that bind to huHGF, antibody containing solutions were tested by ELISA. Briefly, neutravidin coated plates (Thermo Scientific), were blocked with ELISA buffer (0.1 mg/mL BSA, 1×PBS pH 7.4, 0.002% Tween 20 and 0.005% sodium azide) for 1 hr at room temperature. The plates were then coated with a 1 µg/mL biotinylated huHGF solution in ELISA buffer for 1 hour at room temperature. This was followed by a wash step (3× using PBS plus 0.05% Tween 20) and a second block with ELISA buffer. The recombinant antibodies were then added onto the plates and incubated for 1 hour at room temperature and then washed 3× with PBS/Tween solution. For development, an anti-rabbit Fc-HRP (1:5000 dilution in ELISA buffer) was added onto the wells and incubated for 45 min at RT. After a 3× wash step with PBS/Tween solution, the plate was developed using TMB substrate for 3 minutes, stopped using 0.5M HCl and read at 450 nm.

At the time positive antibody titers are established, animals are sacrificed and B cell sources isolated. These sources include: the spleen, lymph nodes, bone marrow, and peripheral blood mononuclear cells (PBMCs). Single cell suspensions are generated, and the cell suspensions are washed to make them compatible for low temperature long term storage. The cells are then typically frozen.

To initiate the antibody identification process, a small fraction of the frozen cell suspensions are thawed, washed, and placed in tissue culture media. These suspensions are then mixed with a biotinylated form of the antigen that was used to generate the animal immune response, and antigen-specific cells are recovered using the Miltenyi magnetic bead cell selection methodology. Specific enrichment is conducted using streptavidin beads. The enriched population is recovered and progressed in the next phase of specific B cell isolation.

Example 2

Production of Clonal, Antigen-Specific B Cell-Containing Culture

Enriched B cells produced according to Example 1 are then plated at varying cell densities per well in a 96 well microtiter plate. Generally, this is at 50, 100, 250, or 500 cells per well with 10 plates per group. The media is supplemented with 4% activated rabbit T cell conditioned media along with 50K frozen irradiated EL4B feeder cells. These cultures are left undisturbed for 5-7 days at which time supernatant-containing secreted antibody is collected and evaluated for target properties in a separate assay setting. The remaining supernatant is left intact, and the plate is frozen at −70° C. Under these conditions, the culture process typically results in wells containing a mixed cell population that comprises a clonal population of antigen-specific B cells, i.e., a single well will only contain a single monoclonal antibody specific to the desired antigen.

Example 3

Screening of Antibody Supernatants for Monoclonal Antibody of Desired Specificity and/or Functional Properties Antibody-containing supernatants derived from the well containing a clonal antigen-specific B cell population produced according to Example 2 are initially screened for antigen recognition using ELISA methods. This includes selective antigen immobilization (e.g., biotinylated antigen capture by streptavidin coated plate), non-specific antigen plate coating, or alternatively, through an antigen build-up strategy (e.g., selective antigen capture followed by binding partner addition to generate a heteromeric protein-antigen complex). Antigen-positive well supernatants are then optionally tested in a function-modifying assay that is strictly dependent on the ligand. One such example is an in vitro protein-protein interaction assay that recreates the natural interaction of the antigen ligand with recombinant receptor protein. Alternatively, a cell-based response that is ligand dependent and easily monitored (e.g., proliferation response) is utilized. Supernatant that displays significant antigen recognition and potency is deemed a positive well. Cells derived from the original positive well are then transitioned to the antibody recovery phase.

Example 4

Recovery of Single, Antibody-Producing B Cell of Desired Antigen Specificity Antigen-specific B cells (produced according to Example 2 or 3), are isolated and used to clone antibody sequences as disclosed in the following example. The cells may be used immediately or snap-frozen in an eppendorf PCR tube for storage at −80° C. until antibody sequence recovery is initiated.

Example 5

Isolation of Antibody Sequences from Antigen-Specific B Cell

Antibody sequences are recovered using a combined RT-PCR based method from a single isolated B-cell produced according to Example 4 or an antigenic specific B cell isolated from the clonal B cell population obtained according to Example 2. Primers are designed to anneal in conserved and constant regions of the target immunoglobulin genes (heavy and light), such as rabbit immunoglobulin sequences, and a two-step nested PCR recovery step is used to obtain the antibody sequence. Amplicons from each well are analyzed for recovery and size integrity. The original heavy and light chain amplicon fragments are then cloned into an expression vector and transformed into bacteria for plasmid propagation and production. Colonies are selected for sequence characterization.

Example 6

Recombinant Production of Monoclonal Antibody of Desired Antigen Specificity and/or Functional Properties Correct full-length antibody sequences for each well containing a single monoclonal antibody is established and miniprep DNA is prepared. This DNA is then used to transfect mammalian cells to produce recombinant full-length antibody. Crude antibody product is tested for antigen recognition and functional properties to confirm the original characteristics are found in the recombinant antibody protein. Where appropriate, large-scale transient mammalian transfections are completed, and antibody is purified through Protein A affinity chromatography. $K_D$ is assessed using standard methods (e.g., surface plasmone resonance or bio-layer interferometry) as well as IC50 in a potency assay.

Example 7

Preparation of Antibodies that Bind HuHGF

By using the antibody selection protocol described herein, a collection of antibodies is generated that include those which exhibit potent functional antagonism of HGF. The antibodies elucidate a variety of HGF epitopes and thus may provide useful alternatives to, or adjunctive with, antibodies that target previously identified HGF epitopes.

Example 8

ELISA Reactivity of Inventive Recombinantly Expressed Anti-HGF Antibodies

To characterize the inventive recombinantly expressed antibodies for their ability to bind to human HGF, antibody-containing solutions were tested by ELISA. All incubations were done at room temperature except coating. Briefly, Immulon 4Hbx plates (Thermo Scientific) were coated with a HGF (R&D Systems, catalog number #294-HGN/CF) containing solution (1 ug/mL in PBS) overnight at 4° C. HGF coated plates were then washed three times in wash buffer (PBS, 0.05% Tween-20). The plates were then blocked using a blocking solution (PBS, 0.5% fish skin gelatin) for approximately one hour. The blocking solution was then removed and the plates were then incubated with a dilution series of the antibody being tested for approximately one hour. At the end of this incubation, the plate was washed three times with wash buffer and further incubated with a secondary antibody containing solution (Peroxidase conjugated affinipure F(ab')2 fragment goat anti-human IgG, Fc fragment specific (Jackson Immunoresearch)) for approximately 45 minutes and washed three times. At that point a substrate solution (TMB peroxidase substrate, BioFx) and incubated for 3 to 5 minutes in the dark. The reaction was stopped by addition of a HCl containing solution (0.5M) and the plate was read at 450 nm in a plate-reader.

The ELISA reactivity of antibodies according to the invention, i.e., of Ab1, Ab2, Ab3, Ab4, Ab5, Ab6, Ab7, Ab8, Ab9, Ab10, Ab11, Ab12, Ab13, Ab14, Ab15, Ab16, Ab17, Ab18, Ab19, Ab21, Ab23, Ab24, Ab25, Ab26, Ab27 and Ab28, determined as described herein, is contained in FIGS. 1-27.

Example 9

Determination of Affinity Constants of Inventive Recombinantly Expressed Anti-HGF Antibodies Determination of Affinity Constants The binding affinity of Ab8 and Ab10, was determined using a Fab fragment. For Ab12, a full-length antibody was used. Papain digestions were conducted using immobilized papain (Thermo/Pierce) as per manufacturer's instructions. Briefly, purified antibodies were incubated in a cystein/HCl-containing buffer with immobilized papain at 37° C. with gentle rocking. The digestion was monitored by taking an aliquot and analyzing using SDS-PAGE for cleavage of the heavy chain. To stop the reaction, the immobilized papain was spun out and washed using 50 mM Tris pH 7.5 and filtered. Undigested full length antibody and Fc fragments were removed by using a MabSelectSure (GE) column.

Binding affinities of monoclonal antibodies and antibody fragments for HGF were estimated using Bio-Layer Interferometry (BLI) on the Octet QK (ForteBio). Biotinylated antibody or antibody fragment was immobilized (1 ug/mL for 500 sec) onto the surface of Streptavidin (SA) Biosensors. A dilution series of human HGF (R&D Systems, catalog number #294-HGN/CF) prepared in 1× Kinetics Buffer (NaCl 0.0138 M; KCl 0.00027 M; 0.1 mg/mL BSA, 0.002% Tween and 0.005% Sodium Azide; pH 7.4, purchased from ForteBio) was used to query the antibodies. Multiple concentrations of antigen (ranging from approximately 80 ng/mL to 640 ng/mL) were used. Association times of 15 minutes and dissociation times of 35 minutes were used with the Octet Analysis Software (v3.1 ForteBio), to fit individual sensor data using a 1:1 Langmuir binding model.

The kinetic binding values for Ab8, Ab10 and Ab12 to human-HGF determined as described above are contained in the Table below.

|  | $k_d$ (1/s) | $k_a$ (1/Ms) | $k_D$ (pM) |
|---|---|---|---|
| Ab8 | 4.55E−05 | 3.73E+05 | 150 |
| Ab10 | 5.13E−05 | 2.05E+05 | 250 |
| Ab12 | 3.73E−05 | 2.76E+05 | 140 |

Example 10

Antitumor Activity of Inventive Recombinantly Expressed Anti-HGF Antibodies

In-Vivo Evaluation

To study the antitumor efficacy of anti-HGF antibodies the ability of anti-HGF antibodies, a subcutaneously implanted U-87MG human glioma xenograft model was used. Five-week-old athymic NCr/nu/nu mice were acclimated for 16 days and subsequently inoculated by subcutaneous injection with U-87MG human glioma cells (ATCC, HTB-14, Lot #1653122) from in vitro cell culture. Each mouse received twenty million ($2 \times 10^7$) U-87MG glioma cells resuspended in 0.2 mL of MEM Eagles media. The cell count and viability were determined with a Beckman Coulter VI CELL XR cell counter and viability analyzer. The day of tumor implantation was designated as Day 0. Tumors were allowed to reach 162-294 mg in weight (162-294 mm$^3$ in size) before the start of treatment. A sufficient number of mice were implanted so that tumors in a weight range as narrow as possible were selected for the trial on the day of treatment initiation (Day 18 after tumor implantation, designated as SD). Those animals selected with tumors in the proper size range were assigned to the various treatment groups so that the median tumor weights on the first day of treatment were as close to each other as possible.

Drug Treatment

Figure 28:
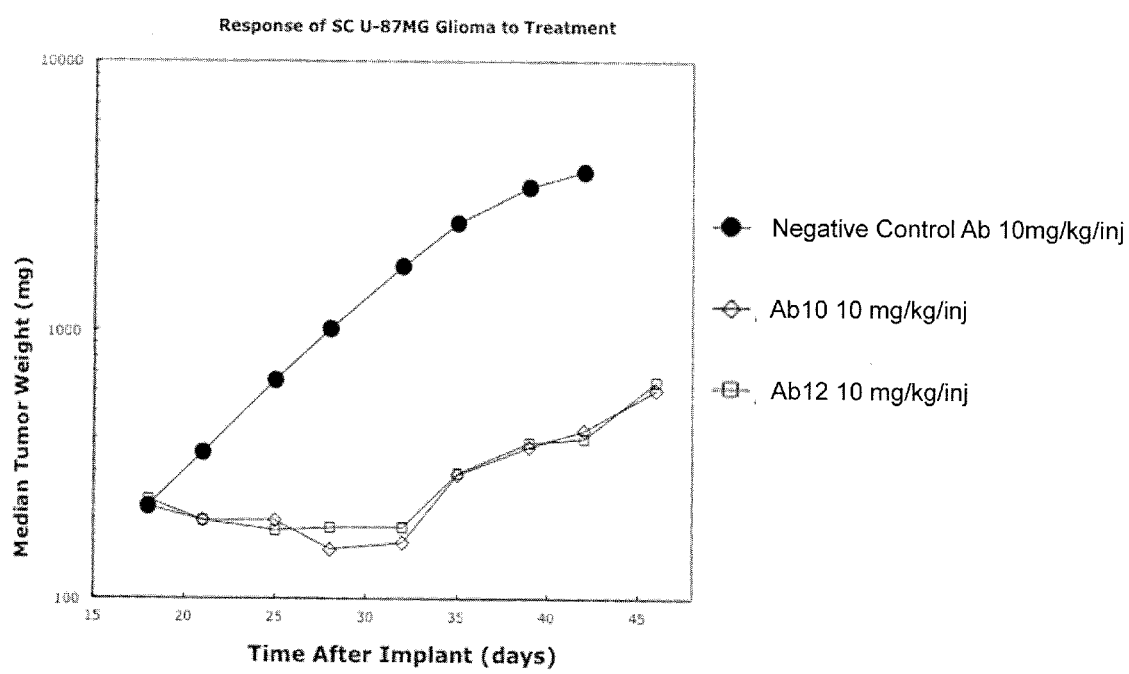
FIG. 28 provides the response of subcutaneous U-87MG glioma to treatment with a negative control antibody, or Ab10 or Ab12 (10 mg/kg/inj) following the protocol corresponding to FIGS. 28 and 29 in Example 10 infra.
Figure 29:
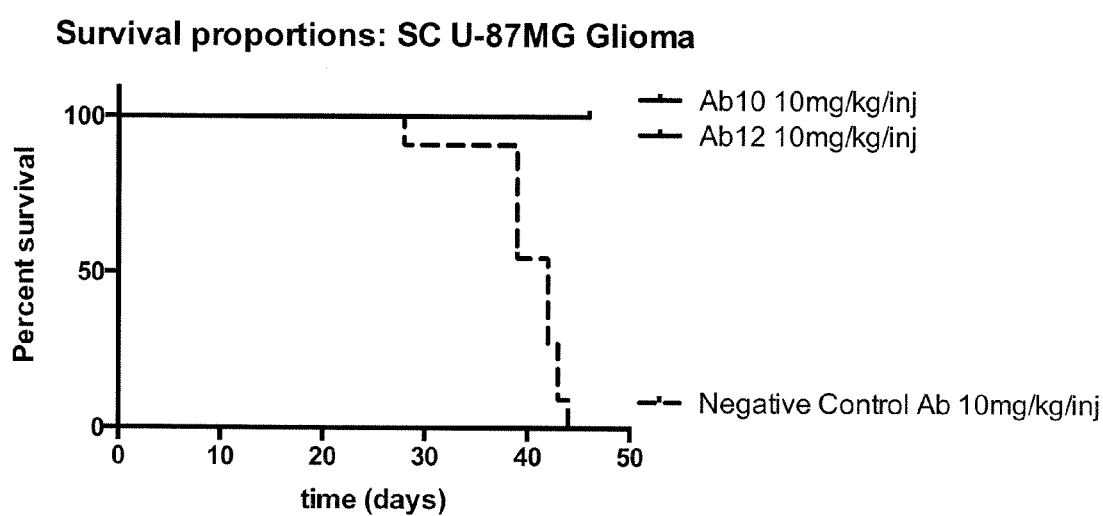
FIG. 29 provides the survival proportions curve of subcutaneous U-87MG glioma treated with either a negative control antibody, or Ab10 or Ab12 (10 mg/kg/inj) obtained following the protocol for FIGS. 28 and 29 in Example 10 infra.

For the antitumor and survival data corresponding to FIGS. 28 and 29, each group consisted of ten animals All test compounds were administered by intraperitoneal (ip) injection every four days for two injections for five weeks (Q4D×2/5 wks) at a dosage of 10 mg/kg/injection.

Figure 30:
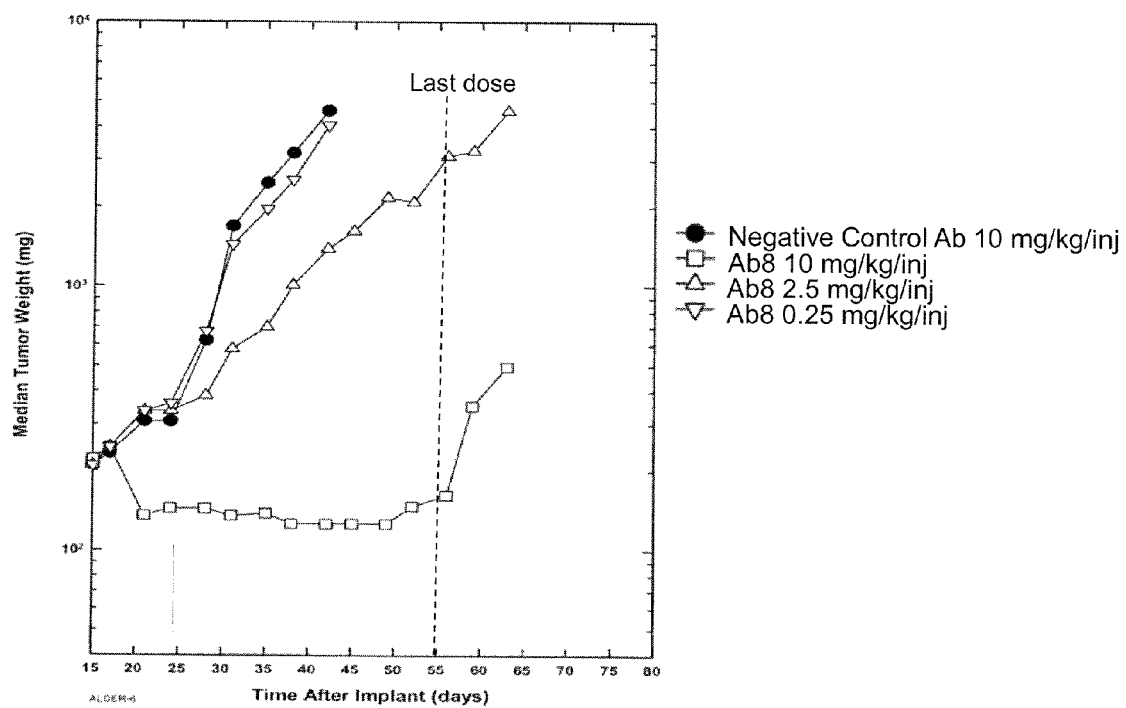
FIG. 30 provides the response of subcutaneous U-87MG glioma to treatment with increasing doses of Ab8 (10, 2.5 and 0.25 mg/kg/inj) or a negative control antibody (10 mg/kg/inj) obtained following the protocol corresponding to FIGS. 30 and 31 described in Example 10 infra.
Figure 31:
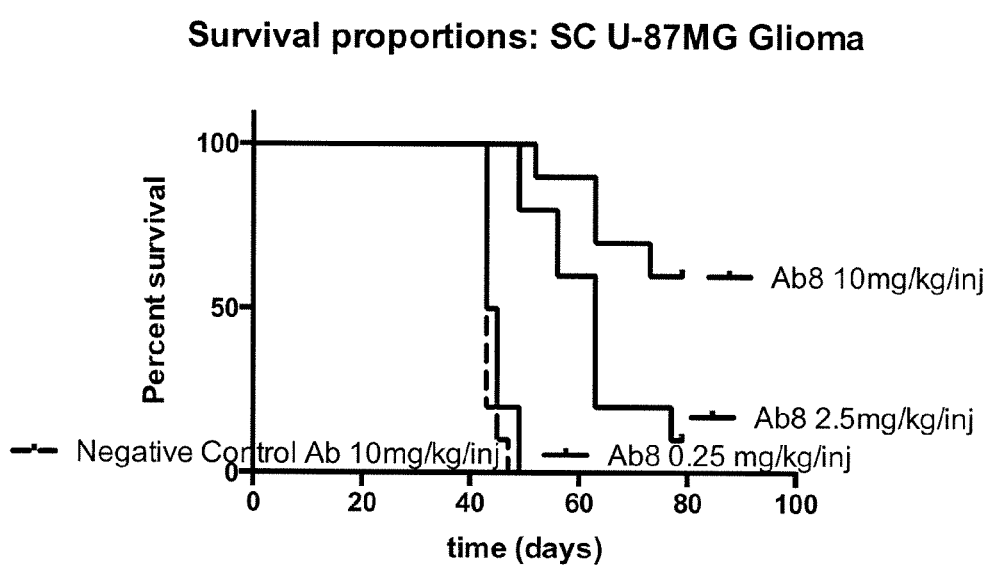
FIG. 31 provides the survival proportions curve of subcutaneous U-87MG glioma treated with either increasing doses of Ab8 (10, 2.5 and 0.25 mg/kg/inj) or a negative control antibody (10 mg/kg/inj) obtained following the experimental protocol corresponding to FIGS. 30 and 31 described in Example 10 infra.

For the antitumor and survival data corresponding to FIGS. 30 and 31; and 32 and 33 respectively, each group again consisted of ten animals. All test compounds were administered by intraperitoneal (ip) injection every four days for two injections for five weeks (Q4D×2/5 wks) at a dosage of 10 mg/kg/injection.

For the antitumor and survival data corresponding to FIGS. 34 and 35, each group again consisted of ten animals. All test compounds were administered by intraperitoneal (ip) injection every four days for two injections for five weeks (Q4D×2/5 wks). The dosage was 30, 10, or 2.5 mg/kg/injection for Ab8 and Ab10. Dosage for the negative control antibody was 30 mg/kg/injection.

Tumor Measurements and Body Weights

The subcutaneous tumors were measured and the animals were weighed twice weekly starting the day of the first treatment. Tumor volume was determined by caliper measurements (mm) and using the formula for an ellipsoid sphere: L×W2/2=mm3, where L and W refer to the larger and smaller perpendicular dimensions collected at each measurement. This formula is also used to calculate tumor weight, assuming unit density (1 mm$^3$=1 mg).

Study Duration

For the data corresponding to FIGS. 28 and 29, the in vivo study was terminated 46 days after tumor implantation. Any animal found moribund or any animal whose tumor reached 4,000 mg, ulcerated, or was sloughed off was euthanized prior to study termination. FIG. 28 provides the response of subcutaneous U-87MG glioma to treatment with a negative control antibody, Ab10 or Ab12 (10 mg/kg/inj) obtained following the protocol. FIG. 29 provides the survival proportions curve of subcutaneous U-87MG glioma treated with either a negative control antibody, or Ab10 or Ab12 (10 mg/kg/inj) obtained following the protocol.

For the antitumor and survival data corresponding to FIGS. 30, 31; and 32 and 33, the in vivo study was terminated 79 days after tumor implantation. Any animal found moribund or any animal whose tumor reached 4,000 mg, ulcerated, or was sloughed off was euthanized prior to study termination. FIG. 30 provides the response of subcutaneous U-87MG glioma to treatment with increasing doses of Ab8 (10, 2.5 and 0.25 mg/kg/inj) and a negative control antibody (10 mg/kg/inj) FIG. 31 provides the survival proportions curve of subcutaneous U-87MG glioma treated with either increasing doses of Ab8 (10, 2.5 and 0.25 mg/kg/inj) or a negative control antibody (10 mg/kg/inj).

Figure 32:
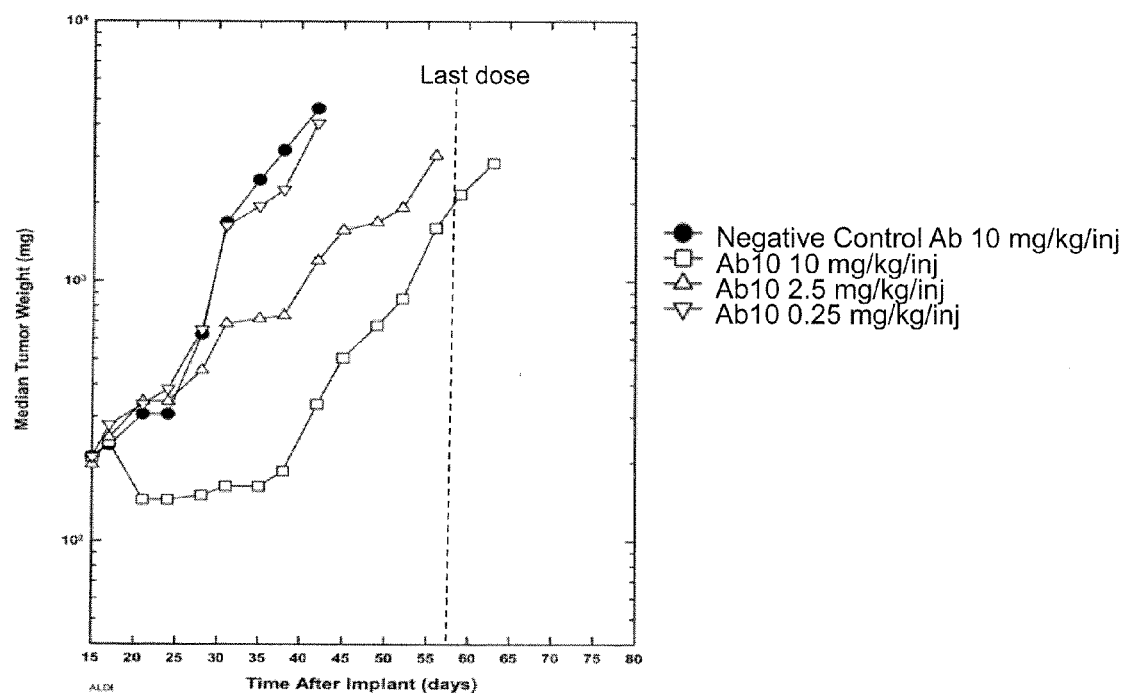
FIG. 32 provides the response of subcutaneous U-87MG glioma to treatment with increasing doses of Ab10 (10, 2.5 and 0.25 mg/kg/inj) or a negative control antibody (10 mg/kg/inj) obtained following the protocol corresponding to FIGS. 32 and 33 described in Example 10 infra.
Figure 33:
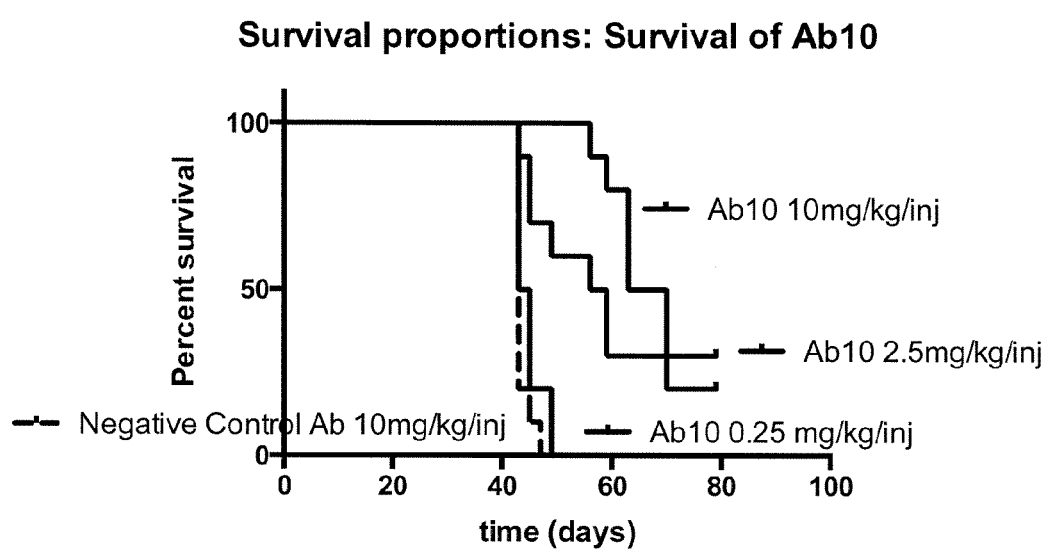
FIG. 33 provides the survival proportions curve of subcutaneous U-87MG glioma treated with either increasing doses of Ab10 (10, 2.5 and 0.25 mg/kg/inj) or a negative control antibody (10 mg/kg/inj) obtained following the protocol corresponding to FIGS. 32 and 33 in Example 10 infra.

FIG. 32 provides the response of subcutaneous U-87MG glioma to treatment with increasing doses of Ab10 (10, 2.5 and 0.25 mg/kg/inj) or a negative control antibody (10 mg/kg/inj). FIG. 33 provides the survival proportions curve of subcutaneous U-87MG glioma treated with either increasing doses of Ab10 (10, 2.5 and 0.25 mg/kg/inj) or a negative control antibody (10 mg/kg/inj).

Figure 34:
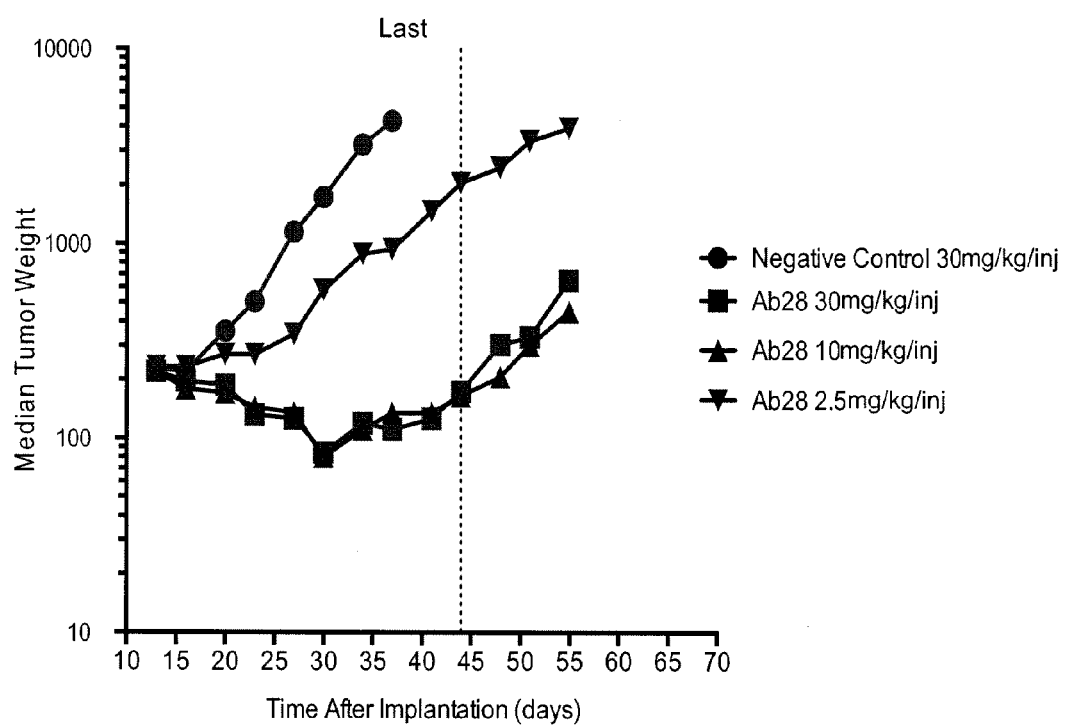
FIG. 34 provides the response of subcutaneous U-87MG glioma to treatment with increasing doses of Ab28 (30, 10, and 2.5 mg/kg/inj) or a negative control antibody (30 mg/kg/inj) obtained following the experimental protocol corresponding to FIGS. 34 and 35 described in Example 10 infra.
Figure 35:
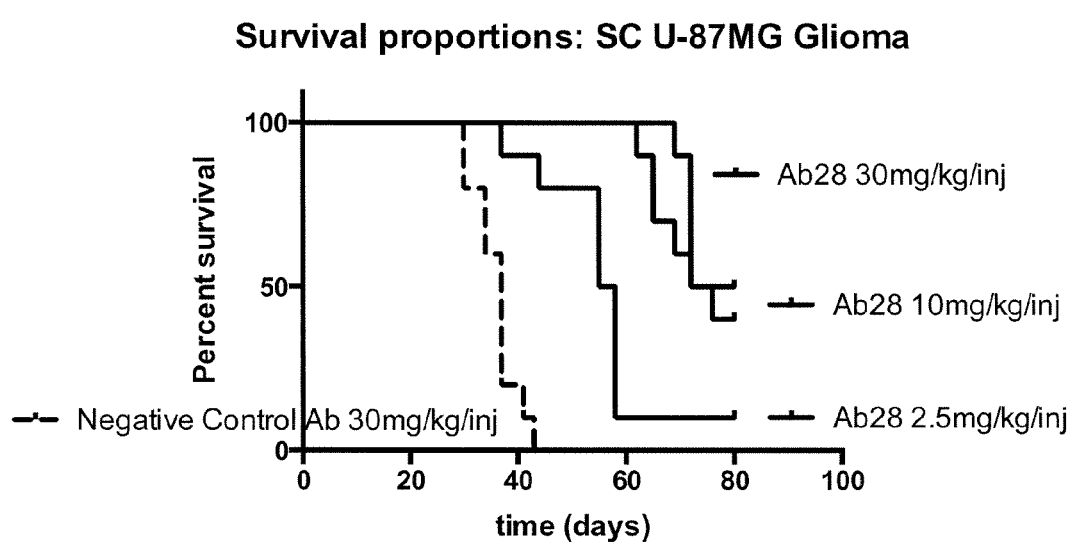
FIG. 35 provides the survival proportions curve of subcutaneous U-87MG glioma treated with either increasing doses of Ab28 (30, 10, and 2.5 mg/kg/inj) or a negative control antibody (30 mg/kg/inj) obtained following the experimental protocol corresponding to FIGS. 34 and 35 described in Example 10 infra.

For the data corresponding to FIGS. 34 and 35, the in vivo study was terminated 80 days after tumor implantation. Any animal found moribund or any animal whose tumor reached 4,000 mg, ulcerated, or was sloughed off was euthanized prior to study termination. FIG. 34 provides the response of subcutaneous U-87MG glioma to treatment with increasing doses of Ab28 (30, 10, and 2.5 mg/kg/inj) or a negative control antibody (30 mg/kg/inj) obtained following the protocol supra. FIG. 35 provides the survival proportions curve of subcutaneous U-87MG glioma treated with either increasing doses of Ab28 (30, 10, and 2.5 mg/kg/inj) or a negative control antibody (30 mg/kg/inj) obtained following the protocol supra.

Example 11

Inhibition of c-met Phosphorylation by Inventive Recombinantly Expressed Anti-HGF Antibodies The c-met receptor has several phosphorylation sites, with unique functions. Y1003 is in the juxtamembrane domain and recruits c-Cb1 protein which is involved in ubiquitination of the receptor. It is said to be a negative regulatory site. Y1234/35 is the major site. It is required for kinase activity and biological functions such as motility and morphogenesis. Y1349 and Y1356 serve as the docking site for proteins like PI3K and PLC-γ.

Figure 36:
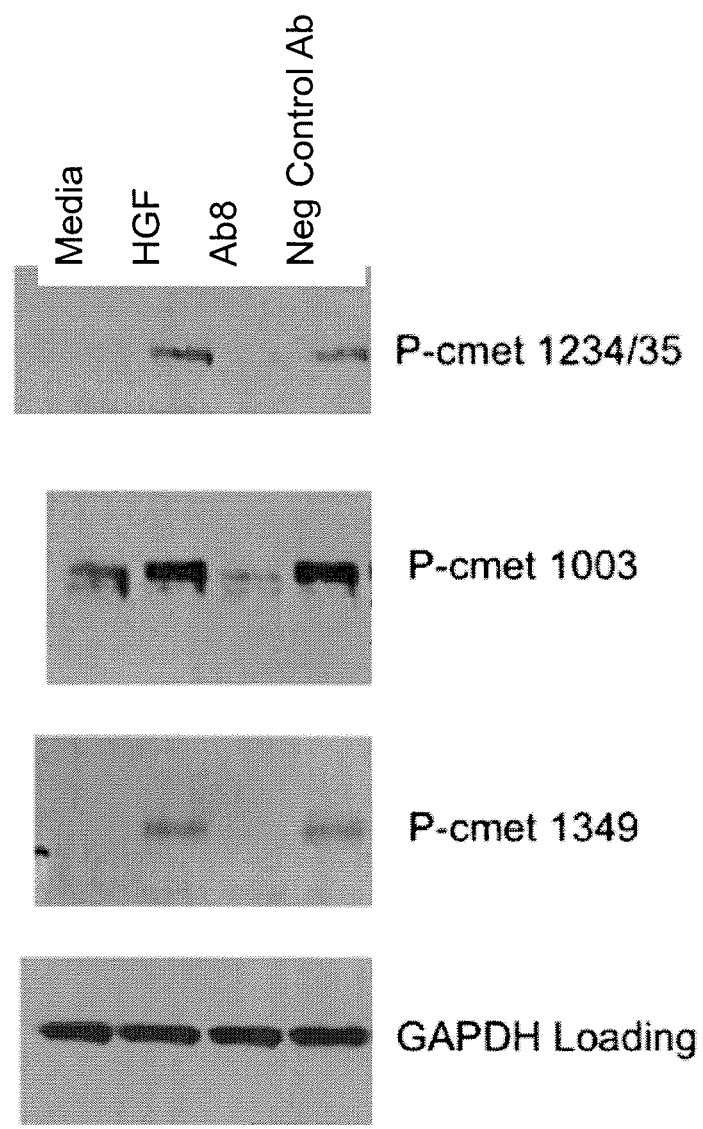
FIG. 36 contains data from experiments showing the inhibition of human-HGF driven phosphorylation of Y1234/35, Y1003 and Y1349 of c-met by Ab8 using PC-3 cells (prostate adenocarcinoma) following the experimental protocol described in Example 11 infra.
Figure 37:
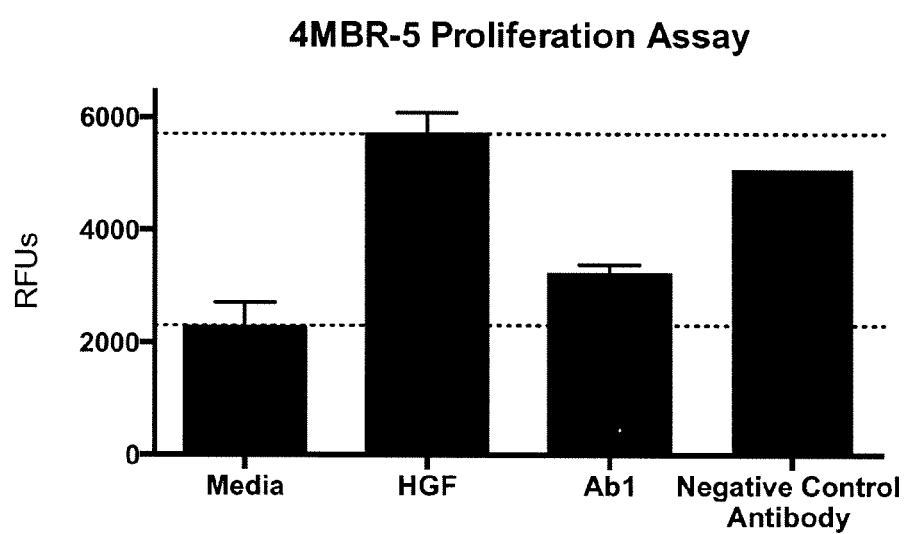
FIGS. 37-50 respectively contain the results of experiments assaying the effect of different anti-HGF antibodies according to the invention (Ab1, Ab2, Ab7, Ab8, Ab9, Ab10, Ab12, Ab14, Ab19, Ab21, Ab23, Ab24, Ab25 and Ab28) on human-HGF driven cell proliferation of 4 mBr-5 cells (rhesus monkey bronchial epithelial cells) following the experimental protocol in Example 12 infra.
Figure 38:
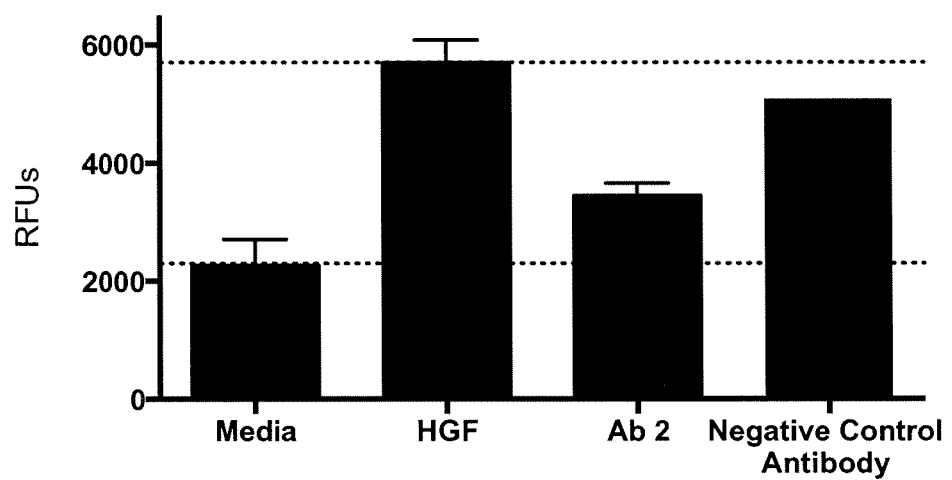

To investigate the ability of Ab8 to inhibit human HGF directed Met phosphorylation, anti-phospho Met western blots were run as follows. Confluent cultures of prostate adenocarcinoma PC-3 cells (CRL-1435, ATCC, Manassas, Va.), previously maintained in growth medium (F-12K, #30-2004, ATCC Manassas, Va.) containing 10% FBS, (Hyclone, Victoria, Australia) were detached using 0.25% Trypsin (Hyclone, Logan, Utah) and seeded in 6 well plates at a density of 500,000 cells/well. After overnight incubation at 37° C., growth media was removed and cells were serum starved overnight in medium with no FBS. Inhibition of human HGF dependent Met phosphorylation by Ab8 or a negative control antibody, was determined by incubating 100 nM antibody and 1.25 nM HGF (Gibco Life Sciences, Cat. Number PH60254) in 15 ml conical tubes in serum free medium for 1 h at 37° C., followed by addition to cells, another 10 min incubation at 37° C., removal of media, cold PBS rinse and cell lysis with Tris lysis buffer (Cat # R6OTX-2, Meso Scale Discovery, Gaithersburg, Md.) supplemented with protease inhibitor cocktail (protease inhibitor, Cat #1836170, Roche, Indianapolis, Ind. plus 10 mM NaF), phosphatase inhibitor cocktail 1 (cat# P-2850, Sigma, St. Louis, Mo.) and phosphatase inhibitor cocktail 2 (cat# P-5726, Sigma, St. Louis, Mo.). Cell lysates were scraped from the 6-well plate and passed through a 23 g needle 5 times while incubating on ice. Approximately 20 ug of total protein were loaded onto a 4-12% Bis-tris Nupage gel (Invitrogen, Carlsbad, Calif.) then transferred via iblot (Invitrogen, Carlsbad, Calif.). Nitrocellulose membranes were blocked with 3% BSA in TBS for 1 h at room temp with gentle shaking and incubated overnight at 4° C. in 3% BSA in TBS+0.1% Tween-20, with one of the following antibodies (Cell Signaling Technologies, Beverly, Mass.): Phospho-Met (Y1234/35) Rabbit mAb (Catalog #3129, Cell Signaling Technologies, Beverly, Mass.), Phospho-Met (Y1349) Rabbit mAb (Catalog #3133, Cell Signaling Technologies, Beverly, Mass.), GAPDH XP Rabbit mAb (Catalog #5174, Cell Signaling Technologies, Beverly, Mass.) or affinity-purified Rabbit Anti-phospho-HGF R/c-met (Y1003) antibody (Catalog #AF4059, R&D Systems, Minneapolis, Minn.). The nitrocellulose membrane was then rinsed 3 times in PBS+0.05% Tween-20 and incubated at room temp 2 h in 3% BSA in TBS+0.1% Tween-20+0.01% SDS containing peroxidase conjugated affinipure goat anti rabbit IgG, Fc fragment specific (#111-035-046, Jackson Immunoresearch, West Grove, Pa.) at 1:10,000 dilution. Then rinsed 3 times as above. Finally, the membranes were developed for 5 min using SuperSignal West Pico Chemiluminescent Substrate and exposed to X-ray film. The results in FIG. 36 show the inhibition of human-HGF driven phosphorylation of Y1234/35, Y1003 and Y1349 of c-met using PC-3 cells (prostate adenocarcinoma) by Ab8. The data therein show that Ab8 shows inhibition of human HGF dependent Met phosphorylation at all sites, whereas the negative control does not alter c-met phosphorylation.

Example 12

Effect of Inventive Recombinantly Expressed Anti-HGF Antibodies on Cell Proliferation Proliferation Assay The effect of anti-HGF antibodies according to the invention on cell proliferation in vitro was assayed. In these experiments, 4 mBr-5 cells (rhesus monkey bronchial epithelial cell line) were obtained from ATCC and were used to characterize the inhibition of HGF driven cell proliferation by multiple antibody preparations. 4 mBr-5 cells are a factor dependent cell line that proliferate when exposed to epidermal growth factor (EGF) or HGF.

4 mBr-5 cells were grown in Ham's F-12K media supplemented with 10% FBS and 50 ng/ml recombinant human EGF (Gibco Life Technologies). The cells were treated with 0.25% trypsin, washed twice with PBS and re-suspended in Ham's F-12K media supplemented with 2.5% FBS (assay media). Cell density was determined using Invitrogen's Countess Automated Cell Counter. Cells at 200,000 cells/ml were seeded using 100 ul per well into a clear bottom black walled 96 well plate (Costar) and incubated overnight. Assay media supplemented with 100 ng/ml HGF (Gibco Life Sciences, Cat. Number PH60254) was incubated in the presence of 10 µg/ml of either a negative control antibody or for 1 hour at 37° C. The media was removed and replaced with assay media alone which was subsequently supplemented with 100 ng/ml HGF, or 100 ng/ml HGF incubated in the presence of the various antibodies. All conditions were performed in triplicate. Cells were allowed to proliferate for 48 hours. The media was removed and the cells washed twice with PBS. Cells were incubated for 30 minutes at 37° C. with 4 µg/ml Calcein AM (Invitrogen) and fluorescence read on a Molecular Devices SpectraMax M2 using excitation/emission maxima 490/520 nm.

FIGS. 37-50 respectively contain the results of these experiments. As shown therein different anti-HGF antibodies according to the invention (Ab1, Ab2, Ab7, Ab8, Ab9, Ab10, Ab12, Ab14, Ab19, Ab21, Ab23, Ab24, Ab25 and Ab28) inhibit proliferation of 4 mBr-5 cells.

Example 13

Figure 39:
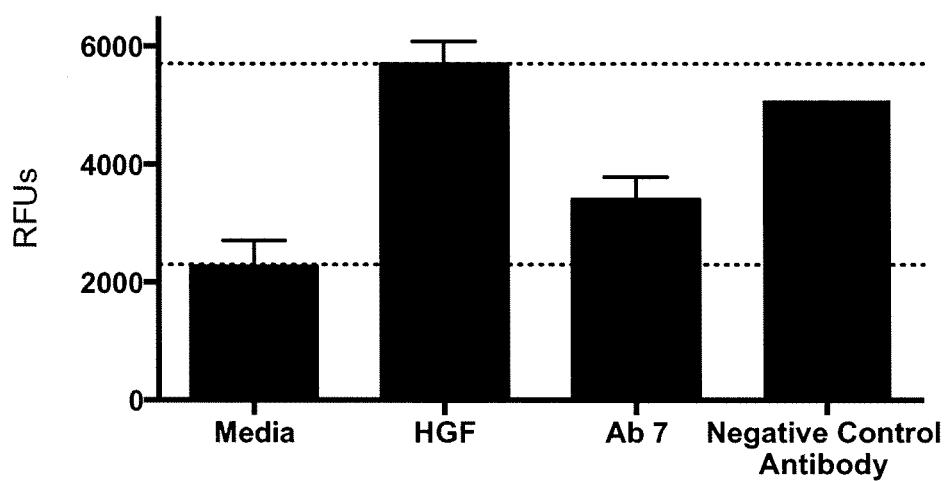
Figure 40:
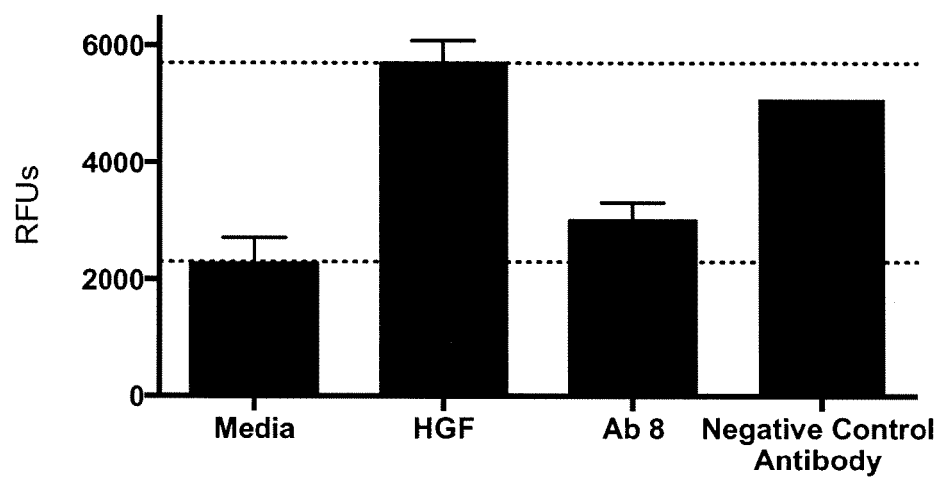
Figure 41:
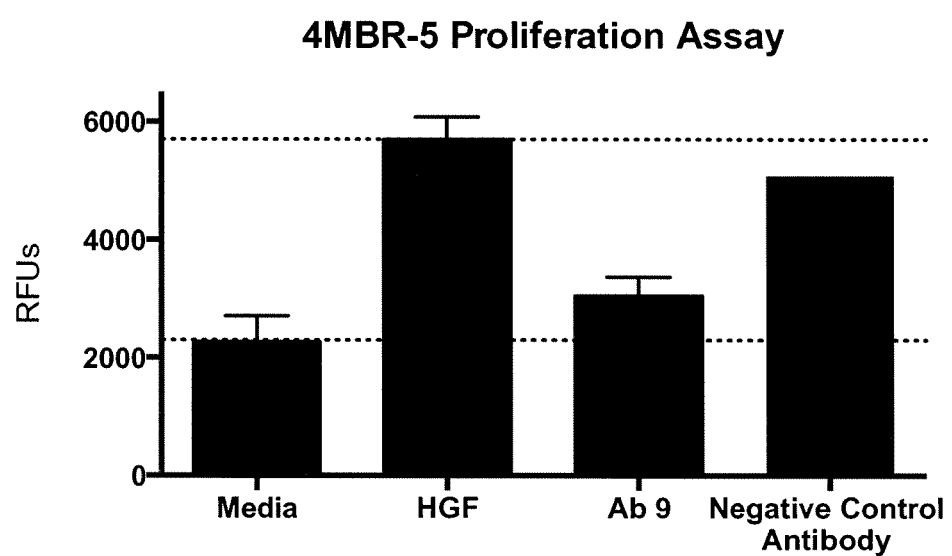
Figure 42:
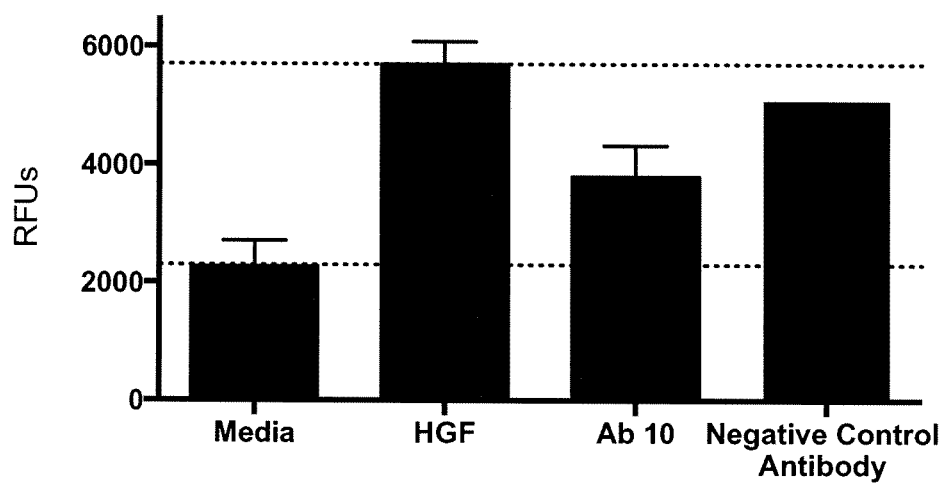
Figure 43:
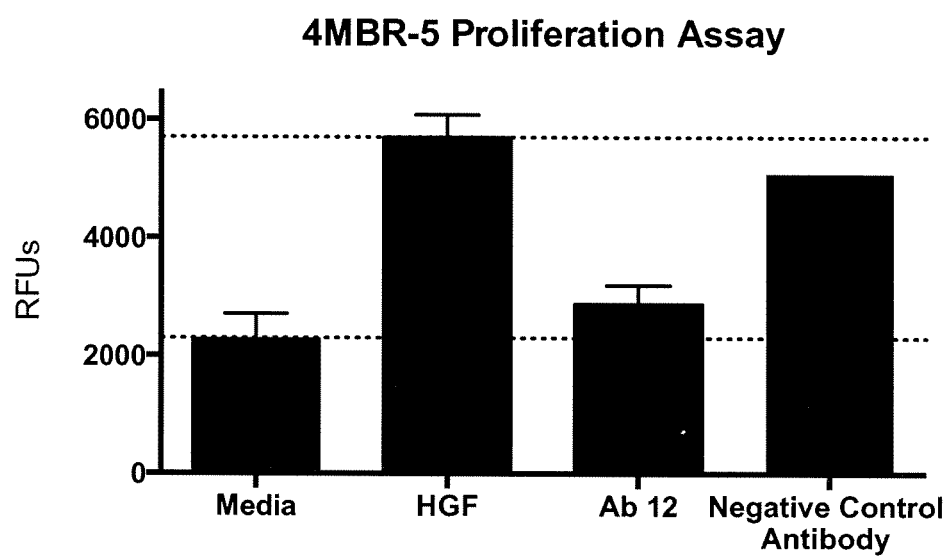
Figure 44:
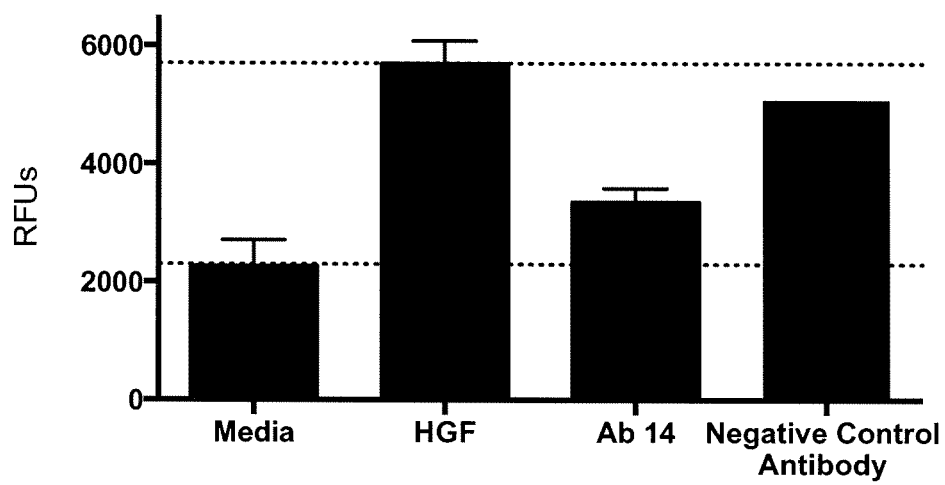
Figure 45:
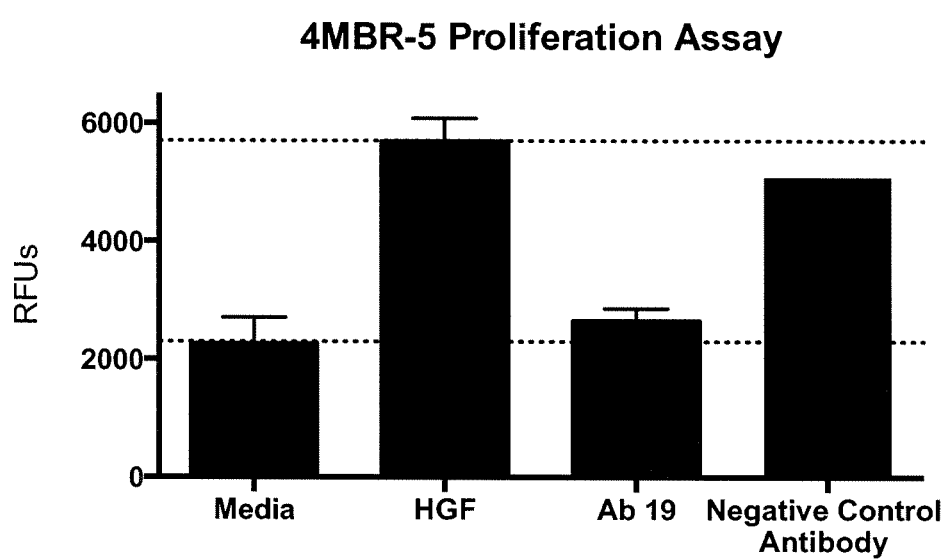
Figure 46:
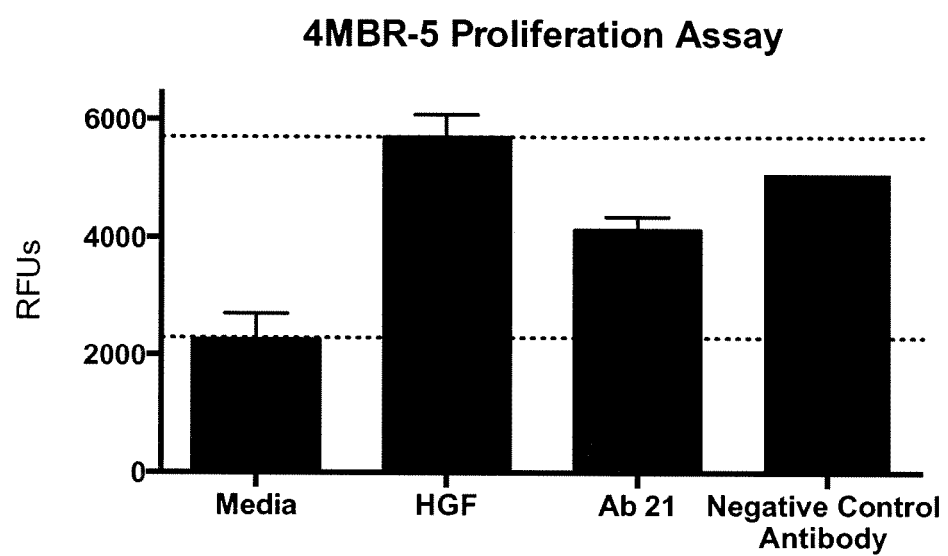
Figure 47:
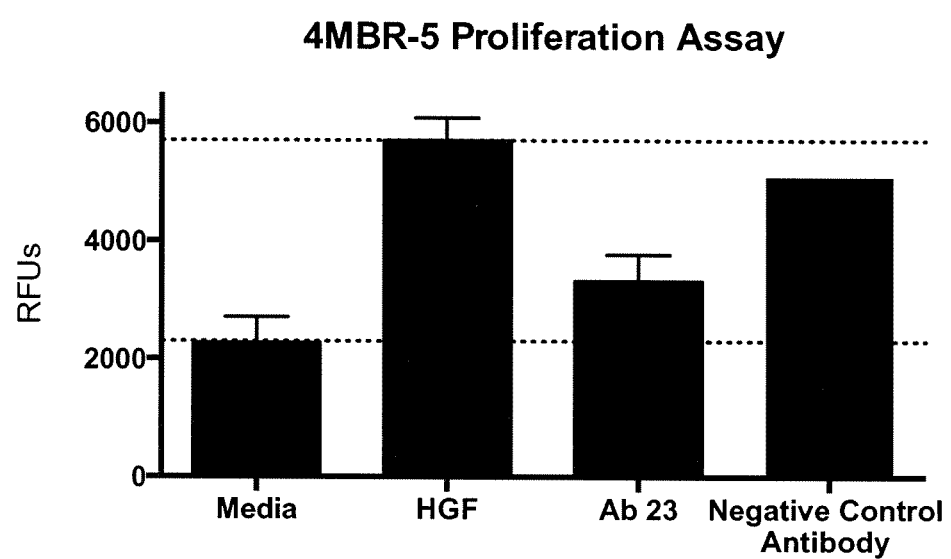
Figure 48:
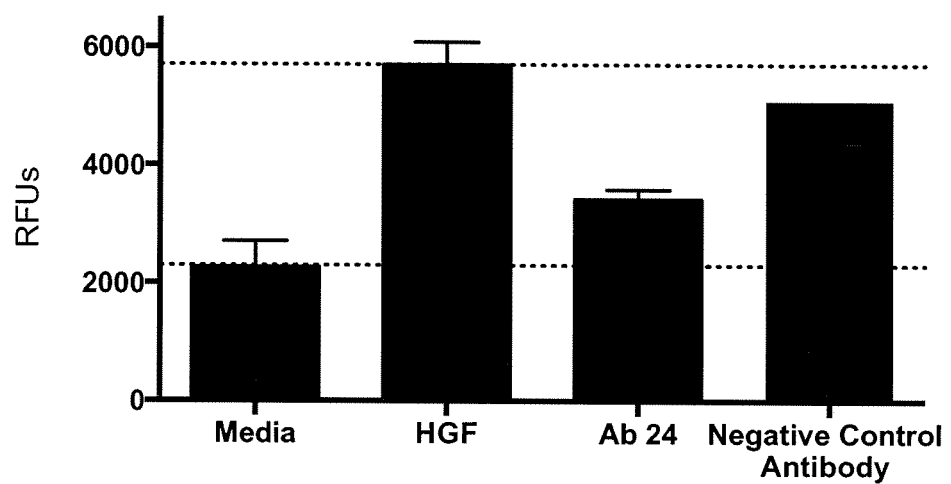
Figure 49:
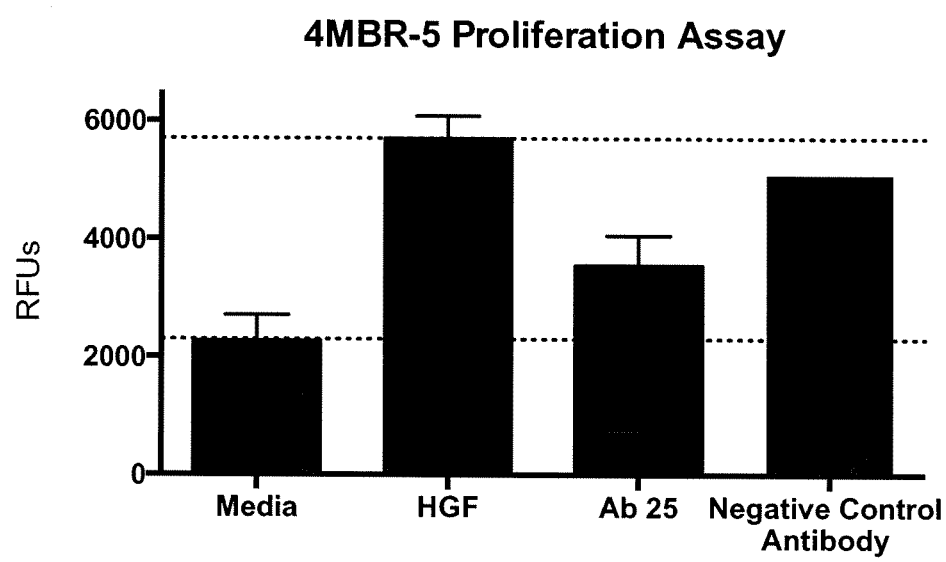
Figure 50:
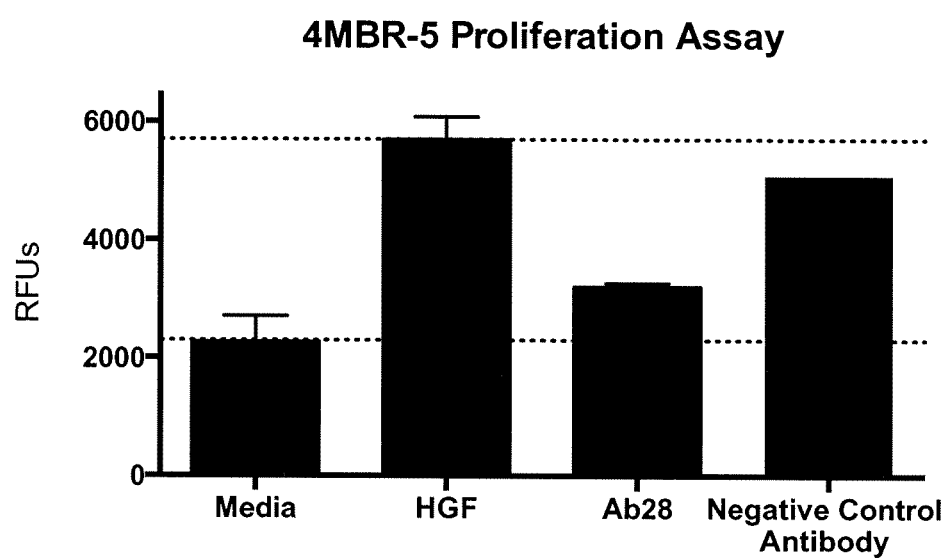
Figure 51:
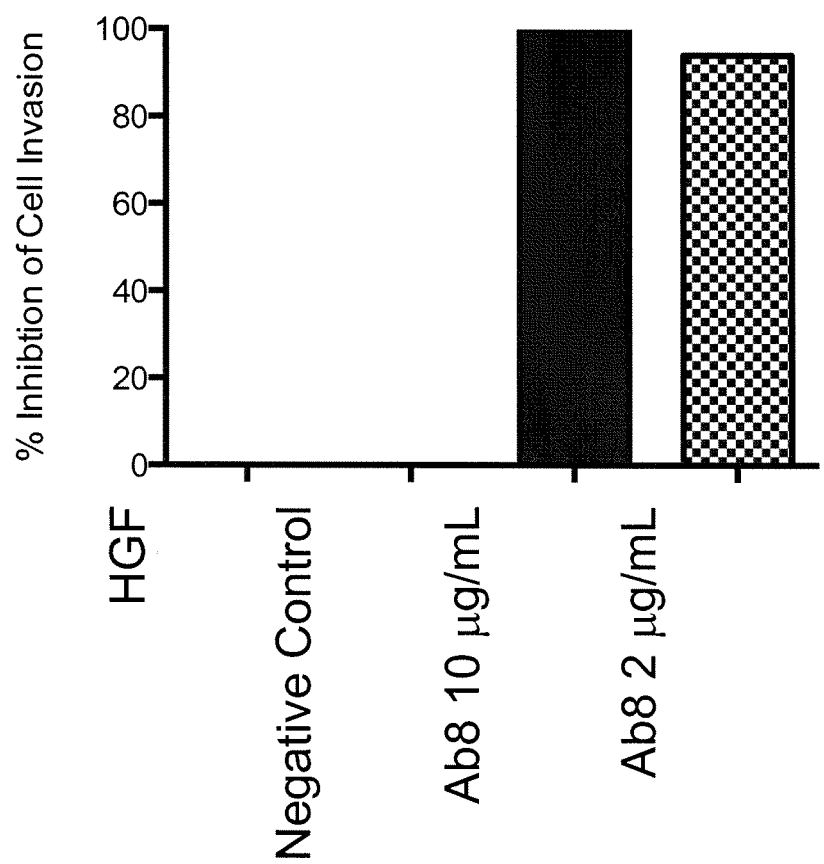
FIG. 51 contains the results of experiments assaying the effect of an anti-HGF antibody (Ab8) according to the invention on human-HGF driven cell invasion of DBTRG cells (human glioblastoma) using Matrigel chambers following the experimental protocol described in Example 13 infra.

Inhibition of Cell Invasion By Inventive Recombinantly Expressed Anti-HGF Antibodies Cell Invasion Assay The effect of anti-HGF antibodies according to the invention on cell invasion was tested. In these experiments, DBTRG cells (human glioblastoma cell line) were obtained from ATCC and were cultured in RPMI-160 supplemented with 10% FBS, L-glutamine (Hyclone), and non-essential amino acids (Hyclone). Growth factor reduced Matrigel invasion chambers (24 well plate, BD Biosciences) were hydrated with 0.75 ml serum free RPMI-1640 in the lower chamber and 0.5 ml in the insert. Chambers were incubated at 37° C. for 2 hours. The media was removed from both chambers and 0.75 ml serum free RPMI 1640 supplemented with 0.1% BSA, and either 10 ng/ml HGF or 10 ng/ml HGF pre-incubated with 2 µg/ml of a negative control antibody or Ab8 for 30 minutes at 37° C. All conditions were performed in duplicate. DBTRG cells were removed from a plate with PBS supplemented using EDTA, pelleted by centrifugation and washed twice with PBS. Cells were then added to the insert chamber using 0.5 ml serum free media at a cell density of 20,000 cells/ml. Chambers were incubated for 24 hours at 37° C. After incubation, the media was removed from the insert and non-invading cells removed with a cotton swab. Inserts were fixed and stained using a Diff-Quick stain kit (source). Membranes were removed from the inserts, air-dried and the invading cells counted by microscopy. As shown in FIG. 39, Ab8 completely blocked DBTRG Matrigel invasion while the negative control antibody had no effect on cell invasion.

CONCLUSION

Described herein are novel anti-HGF antibodies and antibody fragments, nucleic acids, compositions containing and methods of use thereof, especially therapeutic indications when used as a monotherapy or in combination with other therapies or active agents. While the embodiments disclosed herein are preferred, it will be appreciated to one of skill in the art that various alternative, modifications, variations or improvements therein may be made by those skilled in the art, which are intended to be encompassed by the following claims.

The above description of various illustrated embodiments of the invention is not intended to be exhaustive or to limit the invention to the precise form disclosed. While specific embodiments of, and examples for, the invention are described herein for illustrative purposes, various equivalent modifications are possible within the scope of the invention, as those skilled in the relevant art will recognize. The teachings provided herein of the invention can be applied to other purposes, other than the examples described above.

These and other changes can be made to the invention in light of the above detailed description. In general, in the following claims, the terms used should not be construed to limit the invention to the specific embodiments disclosed in the specification and the claims. Accordingly, the invention is not limited by the disclosure, but instead the scope of the invention is to be determined entirely by the following claims.

The invention may be practiced in ways other than those particularly described in the foregoing description and examples. Numerous modifications and variations of the invention are possible in light of the above teachings and, therefore, are within the scope of the appended claims.

Certain teachings related to methods for obtaining a clonal population of antigen-specific B cells were disclosed in U.S. Provisional patent application Ser. No. 60/801,412, filed May 19, 2006, the disclosure of which is herein incorporated by reference in its entirety.

Certain teachings related to humanization of rabbit-derived monoclonal antibodies and preferred sequence modifications to maintain antigen binding affinity were disclosed in International Application No. PCT/US2008/064421, corresponding to International Publication No. WO/2008/144757, entitled "Novel Rabbit Antibody Humanization Methods and Humanized Rabbit Antibodies", filed May 21, 2008, the disclosure of which is herein incorporated by reference in its entirety.

Certain teachings related to producing antibodies or fragments thereof using mating competent yeast and corresponding methods were disclosed in U.S. patent application Ser. No. 11/429,053, filed May 8, 2006, (U.S. Patent Application Publication No. US2006/0270045), the disclosure of which is herein incorporated by reference in its entirety.

Certain HGF antibody polynucleotides and polypeptides are disclosed in the sequence listing accompanying this patent application filing, and the disclosure of said sequence listing is herein incorporated by reference in its entirety.

The entire disclosure of each document cited (including patents, patent applications, journal articles, abstracts, manuals, books, or other disclosures) in the Background of the Invention, Detailed Description, and Examples is herein incorporated by reference in their entireties.

SEQUENCE LISTING (1080 sequences)

SEQ ID NO: 1 - protein, 446 aa, Artificial
  Humanized antibody sequence
QSVEESGGRLVTPGTPLTLTCTVSGFSLSAYAMSWVRQAPEKGLEWIAVIYVIGATDYASWAKGRFTISRTSTTVDLRIPSPTTEDTATYFCARVYDSVWNHFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 116 aa, Artificial
  Humanized antibody sequence
QSVEESGGRLVTPGTPLTLTCTVSGFSLSAYAMSWVRQAPEKGLEWIAVIYVIGATDYASWAKGRFTISRTSTTVDLRIPSPTTEDTATYFCARVYDSVWNHFNLWGPGTLVTVSS

SEQ ID NO: 3 - protein, 29 aa, Oryctolagus cuniculus
QSVEESGGRLVTPGTPLTLTCTVSGFSLS

SEQ ID NO: 4 - protein, 5 aa, Oryctolagus cuniculus
AYAMS

SEQ ID NO: 5 - protein, 14 aa, Oryctolagus cuniculus
WVRQAPEKGLEWIA

SEQ ID NO: 6 - protein, 16 aa, Oryctolagus cuniculus
VIYVIGATDYASWAKG

SEQ ID NO: 7 - protein, 30 aa, Oryctolagus cuniculus
RFTISRTSTTVDLRIPSPTTEDTATYFCAR

SEQ ID NO: 8 - protein, 11 aa, Oryctolagus cuniculus
VYDSVWNHFNL

SEQ ID NO: 9 - protein, 11 aa, Artificial
  Humanized antibody sequence
WGPGTLVTVSS

SEQ ID NO: 10 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - DNA, 1338 bp, Artificial
  Humanized antibody sequence
cagtcggtggaggagtccgggggtcgcctggtcacgcctgggacacccctgacactcacctgcacagtctctggattctccctcagtgcctatgcaatgagctgggtccgccaggctccagagaaggggctggagtggatcgcagtcatttatgttattggtgccactgactacgcgagctgggcgaaaggccgattcaccatctccagaacctcgaccacggtggatctgagaatccccagtccgacaaccgaggacacggccacctatttctgtgccagagtttatgattctgtctggaatcactttaacttgtggggcccgggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 12 - DNA, 348 bp, Artificial
  Humanized antibody sequence
cagtcggtggaggagtccgggggtcgcctggtcacgcctgggacacccctgacactcacctgcacagtctctggattctccctcagtgcctatgcaatgagctgggtccgccaggctccagagaaggggctggagtggatcgcagtcatttatgttattggtgccactgactacgcgagctgggcgaaaggccgattcaccatctccagaacctcgaccacggtggatctgagaatccccagtccgacaaccgaggacacggccacctatttctgtgccagagtttatgattctgtctggaatcactttaacttgtggggcccgggcaccctggtcaccgtctcgagc

SEQ ID NO: 13 - DNA, 87 bp, Oryctolagus cuniculus
cagtcggtggaggagtccgggggtcgcctggtcacgcctgggacacccctgacactcacctgcacagtctctggattctccctcagt

SEQ ID NO: 14 - DNA, 15 bp, Oryctolagus cuniculus
gcctatgcaatgagc

SEQ ID NO: 15 - DNA, 42 bp, Oryctolagus cuniculus
tgggtccgccaggctccagagaaggggctggagtggatcgca

SEQ ID NO: 16 - DNA, 48 bp, Oryctolagus cuniculus
gtcatttatgttattggtgccactgactacgcgagctgggcgaaaggc

SEQ ID NO: 17 - DNA, 90 bp, Oryctolagus cuniculus
cgattcaccatctccagaacctcgaccacggtggatctgagaatccccagtccgacaaccgaggacacggccacctatttctgtgccaga

SEQ ID NO: 18 - DNA, 33 bp, Oryctolagus cuniculus
gtttatgattctgtctggaatcactttaacttg

SEQ ID NO: 19 - DNA, 33 bp, Artificial
  Humanized antibody sequence
tggggcccgggcaccctggtcaccgtctcgagc

SEQ ID NO: 20 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 21 - protein, 217 aa, Artificial
  Humanized antibody sequence
AYDMTQTPASVEVAVGGTVTIKCQASQSISSWLAWYQQKPGQPPKLLIYQASKLASGVPSRFKGSGSGTEFTLTISGVECADAATYYCQQAYSVSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 111 aa, Artificial
  Humanized antibody sequence
AYDMTQTPASVEVAVGGTVTIKCQASQSISSWLAWYQQKPGQPPKLLIYQASKLASGVPSRFKGSGSGTEFTLTISGVECADAATYYCQQAYSVSNVDNAFGGGTEVVVKR

SEQ ID NO: 23 - protein, 23 aa, Oryctolagus cuniculus
AYDMTQTPASVEVAVGGTVTIKC

SEQ ID NO: 24 - protein, 11 aa, Oryctolagus cuniculus
QASQSISSWLA

SEQ ID NO: 25 - protein, 15 aa, Oryctolagus cuniculus
WYQQKPGQPPKLLIY

SEQ ID NO: 26 - protein, 7 aa, Oryctolagus cuniculus
QASKLAS

SEQ ID NO: 27 - protein, 32 aa, Oryctolagus cuniculus
GVPSRFKGSGSGTEFTLTISGVECADAATYYC

SEQ ID NO: 28 - protein, 12 aa, Oryctolagus cuniculus
QQAYSVSNVDNA

SEQ ID NO: 29 - protein, 11 aa, Artificial
  Humanized antibody sequence
FGGGTEVVVKR

SEQ ID NO: 30 - protein, 106 aa, Artificial
  Humanized antibody sequence
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 31 - DNA, 651 bp, Artificial
  Humanized antibody sequence
gcctatgatatgacccagactccagcctctgtggaggtagctgtggggggcacagtcaccatcaagtgccaggccagtcagagcattagcagttggttagcctggtatcagcagaaaccagggcagcctcccaagctcctgatctaccaggcatctaaactggcatctggggtcccatcgcggttcaaaggcagtggatctgggacagagttcactctcaccatcagcggcgtggagtgtgccgatgctgccacttactattgtcaacaggcttatagtgttagtaatgttgataatgctttcggcggagggaccgaggtggtggtcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 32 - DNA, 333 bp, Artificial
  Humanized antibody sequence
gcctatgatatgacccagactccagcctctgtggaggtagctgtggggggcacagtcaccatcaagtgccaggccagtcagagcattagcagttggttagcctggtatcagcagaaaccagggcagcctcccaagctcctgatctaccaggcatctaaactggcatctggggtcccatcgcggttcaaaggcagtggatctgggacagagttcactctcaccatcagcggcgtggagtgtgccgatgctgccacttactattgtcaacaggcttatagtgttagtaatgttgataatgctttcggcggagggaccgaggtggtggtcaaacgt

SEQ ID NO: 33 - DNA, 69 bp, Oryctolagus cuniculus
gcctatgatatgacccagactccagcctctgtggaggtagctgtggggggcacagtcaccatcaagtgc

SEQ ID NO: 34 - DNA, 33 bp, Oryctolagus cuniculus
caggccagtcagagcattagcagttggttagcc

SEQ ID NO: 35 - DNA, 45 bp, Oryctolagus cuniculus
tggtatcagcagaaaccagggcagcctcccaagctcctgatctac

SEQ ID NO: 36 - DNA, 21 bp, Oryctolagus cuniculus
caggcatctaaactggcatct

SEQ ID NO: 37 - DNA, 96 bp, Oryctolagus cuniculus
ggggtcccatcgcggttcaaaggcagtggatctgggacagagttcactctcaccatcagcggcgtggagtgtgccgatgctgccacttactattgt

SEQ ID NO: 38 - DNA, 36 bp, Oryctolagus cuniculus
caacaggcttatagtgttagtaatgttgataatgct

SEQ ID NO: 39 - DNA, 33 bp, Artificial
  Humanized antibody sequence
ttcggcggagggaccgaggtggtggtcaaacgt

SEQ ID NO: 40 - DNA, 318 bp, Artificial
  Humanized antibody sequence
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 41 - protein, 449 aa, Artificial
  Humanized antibody sequence
EVQLVESGGGLVQPGGSLRLSCAASGFTVSAYAMSWVRQAPGKGLEWVAVIYVIGATDYASSAKGRFTISRDNSKNTLYLQMNSLRAEDTAVYYCARVYDSVWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 119 aa, Artificial
  Humanized antibody sequence
EVQLVESGGGLVQPGGSLRLSCAASGFTVSAYAMSWVRQAPGKGLEWVAVIYVIGATDYASSAKGRFTISRDNSKNTLYLQMNSLRAEDTAVYYCARVYDSVWNHFNLWGQGTLVTVSS

SEQ ID NO: 43 - protein, 30 aa, Artificial
  Humanized antibody sequence
EVQLVESGGGLVQPGGSLRLSCAASGFTVS

SEQ ID NO: 44 - protein, 5 aa, Oryctolagus cuniculus
AYAMS

SEQ ID NO: 45 - protein, 14 aa, Artificial
  Humanized antibody sequence
WVRQAPGKGLEWVA

SEQ ID NO: 46 - protein, 16 aa, Artificial
  Humanized antibody sequence
VIYVIGATDYASSAKG

SEQ ID NO: 47 - protein, 32 aa, Artificial
  Humanized antibody sequence
RFTISRDNSKNTLYLQMNSLRAEDTAVYYCAR

SEQ ID NO: 48 - protein, 11 aa, Oryctolagus cuniculus
VYDSVWNHFNL

SEQ ID NO: 49 - protein, 11 aa, Artificial
  Humanized antibody sequence
WGQGTLVTVSS

SEQ ID NO: 50 - protein, 330 aa, Artificial; identical to SEQ ID NO: 10
  Humanized antibody sequence

SEQ ID NO: 51 - DNA, 1347 bp, Artificial
  Humanized antibody sequence
gaggtgcagctggtggagtctgggggaggcttggtccagcctggggggtccctgagactctcctgtgcagcctctggattcaccgtcagtgcctatgcaatgagctgggtccgtcaggctccagggaaggggctggagtgggtcgcagtcatctatgttattggtgccactgactacgcgagcagtgcgaaaggccgattcaccatctccagagacaattccaagaacaccctgtatcttcaaatgaacagcctgagagctgaggacactgctgtgtattactgtgctagagtttatgattctgtctggaatcacttcaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - DNA, 357 bp, Artificial
  Humanized antibody sequence
gaggtgcagctggtggagtctgggggaggcttggtccagcctggggggtccctgagactctcctgtgcagcctctggattcaccgtcagtgcctatgcaatgagctgggtccgtcaggctccagggaaggggctggagtgggtcgcagtcatctatgttattggtgccactgactacgcgagcagtgcgaaaggccgattcaccatctccagagacaattccaagaacaccctgtatcttcaaatgaacagcctgagagctgaggacactgctgtgtattactgtgctagagtttatgattctgtctggaatcacttcaacttgtggggccaagggaccctcgtcaccgtctcgagc

SEQ ID NO: 53 - DNA, 90 bp, Artificial
  Humanized antibody sequence
gaggtgcagctggtggagtctgggggaggcttggtccagcctggggggtccctgagactctcctgtgcagcctctggattcaccgtcagt

SEQ ID NO: 54 - DNA, 15 bp, Oryctolagus cuniculus
gcctatgcaatgagc

SEQ ID NO: 55 - DNA, 42 bp, Artificial
  Humanized antibody sequence
tgggtccgtcaggctccagggaaggggctggagtgggtcgca

SEQ ID NO: 56 - DNA, 48 bp, Artificial
  Humanized antibody sequence
gtcatctatgttattggtgccactgactacgcgagcagtgcgaaaggc

SEQ ID NO: 57 - DNA, 96 bp, Artificial
  Humanized antibody sequence
cgattcaccatctccagagacaattccaagaacaccctgtatcttcaaatgaacagcctgagagctgaggacactgctgtgtattactgtgctaga

SEQ ID NO: 58 - DNA, 33 bp, Oryctolagus cuniculus
gtttatgattctgtctggaatcacttcaacttg

SEQ ID NO: 59 - DNA, 33 bp, Artificial
  Humanized antibody sequence
tggggccaagggaccctcgtcaccgtctcgagc

SEQ ID NO: 60 - DNA, 990 bp, Artificial; identical to SEQ ID NO: 20
  Humanized antibody sequence

SEQ ID NO: 61 - protein, 217 aa, Artificial
  Humanized antibody sequence
DIQMTQSPSTLSASVGDRVTITCQASQSISSWLAWYQQKPGKAPKLLIYQASKLASGVPSRFSGSGSGTEFTLTISSLQPDDFATYYCQQAYSVSNVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 111 aa, Artificial
  Humanized antibody sequence
DIQMTQSPSTLSASVGDRVTITCQASQSISSWLAWYQQKPGKAPKLLIYQASKLASGVPSRFSGSGSGTEFTLTISSLQPDDFATYYCQQAYSVSNVDNAFGGGTKVEIKR

SEQ ID NO: 63 - protein, 23 aa, Artificial
  Humanized antibody sequence
DIQMTQSPSTLSASVGDRVTITC

SEQ ID NO: 64 - protein, 11 aa, Oryctolagus cuniculus
QASQSISSWLA

SEQ ID NO: 65 - protein, 15 aa, Artificial
  Humanized antibody sequence
WYQQKPGKAPKLLIY

SEQ ID NO: 66 - protein, 7 aa, Oryctolagus cuniculus
QASKLAS

SEQ ID NO: 67 - protein, 32 aa, Artificial
  Humanized antibody sequence
GVPSRFSGSGSGTEFTLTISSLQPDDFATYYC

SEQ ID NO: 68 - protein, 12 aa, Oryctolagus cuniculus
QQAYSVSNVDNA

SEQ ID NO: 69 - protein, 11 aa, Artificial
  Humanized antibody sequence
FGGGTKVEIKR

SEQ ID NO: 70 - protein, 106 aa, Artificial; identical to SEQ ID NO: 30
  Humanized antibody sequence

SEQ ID NO: 71 - DNA, 651 bp, Artificial
  Humanized antibody sequence
gacatccagatgacccagtctccttccaccctgtctgcatctgtaggagacagagtcaccatcacttgccaggccagtcagagcattagcagttggttagcctggtatcagcagaaaccaggaaaagcccctaagctcctgatctatcaggcatctaaactggcatctggagtcccatcaaggttcagcggcagtggatctggaacagaattcactctcaccatcagcagcctgcagcctgatgattttgcaacttattactgccaacaggcttatagtgttagtaatgttgataatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 72 - DNA, 333 bp, Artificial
  Humanized antibody sequence
gacatccagatgacccagtctccttccaccctgtctgcatctgtaggagacagagtcaccatcacttgccaggccagtcagagcattagcagttggttagcctggtatcagcagaaaccaggaaaagcccctaagctcctgatctatcaggcatctaaactggcatctggagtcccatcaaggttcagcggcagtggatctggaacagaattcactctcaccatcagcagcctgcagcctgatgattttgcaacttattactgccaacaggcttatagtgttagtaatgttgataatgctttcggcggaggaaccaaggtggaaatcaaacgt

SEQ ID NO: 73 - DNA, 69 bp, Artificial
  Humanized antibody sequence
gacatccagatgacccagtctccttccaccctgtctgcatctgtaggagacagagtcaccatcacttgc

SEQ ID NO: 74 - DNA, 33 bp, Oryctolagus cuniculus; identical to SEQ ID NO: 34

SEQ ID NO: 75 - DNA, 45 bp, Artificial
  Humanized antibody sequence
tggtatcagcagaaaccaggaaaagcccctaagctcctgatctat

SEQ ID NO: 76 - DNA, 21 bp, Oryctolagus cuniculus
caggcatctaaactggcatct

SEQ ID NO: 77 - DNA, 96 bp, Artificial
  Humanized antibody sequence
ggagtcccatcaaggttcagcggcagtggatctggaacagaattcactctcaccatcagcagcctgcagcctgatgattttgcaacttattactgc

SEQ ID NO: 78 - DNA, 36 bp, Oryctolagus cuniculus; identical to SEQ ID NO: 38

SEQ ID NO: 79 - DNA, 33 bp, Artificial
  Humanized antibody sequence
ttcggcggaggaaccaaggtggaaatcaaacgt

SEQ ID NO: 80 - DNA, 318 bp, Artificial
  Humanized antibody sequence
acggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 81 - protein, 447 aa, Artificial
  Humanized antibody sequence
QSVEESGGRLVTPGTPLTLTCTVSGLTISSYYMSWVRQAPGKGLEWIGTINPGANTYFASWAKGRFTISRTSTTVDLKITSPTTEDTATYFCAREGDSNDWGVFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 117 aa, Artificial
  Humanized antibody sequence
QSVEESGGRLVTPGTPLTLTCTVSGLTISSYYMSWVRQAPGKGLEWIGTINPGANTYFASWAKGRFTISRTSTTVDLKITSPTTEDTATYFCAREGDSNDWGVFDLWGQGTLVTVSS

SEQ ID NO: 83 - protein, 29 aa, Artificial
  Humanized antibody sequence
QSVEESGGRLVTPGTPLTLTCTVSGLTIS

SEQ ID NO: 84 - protein, 5 aa, Oryctolagus cuniculus
SYYMS

SEQ ID NO: 85 - protein, 14 aa, Artificial
  Humanized antibody sequence
WVRQAPGKGLEWIG

SEQ ID NO: 86 - protein, 16 aa, Oryctolagus cuniculus
TINPGANTYFASWAKG

SEQ ID NO: 87 - protein, 30 aa, Artificial
  Humanized antibody sequence
RFTISRTSTTVDLKITSPTTEDTATYFCAR

SEQ ID NO: 88 - protein, 12 aa, Oryctolagus cuniculus
EGDSNDWGVFDL

SEQ ID NO: 89 - protein, 11 aa, Artificial
  Humanized antibody sequence
WGQGTLVTVSS

SEQ ID NO: 90 - protein, 330 aa, Artificial; identical to SEQ ID NO: 10
  Humanized antibody sequence

SEQ ID NO: 91 - DNA, 1341 bp, Artificial
  Humanized antibody sequence
cagtcggtggaggagtccgggggtcgcctggtcacgcctgggacacccttgacactcacctgcacagtctctggactcaccattagtagctactacatgagctgggtccgccaggctccagggaaggggctggaatggatcggaaccattaatcctggtgctaacacatacttcgcgagctgggcaaaaggccgattcaccatctccagaacctcgaccacggtggatctgaaaatcaccagtccgacaaccgaggacacggccacatatttctgtgccagagagggggatagtaatgactggggtgtctttgacttgtggggccagggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 92 - DNA, 351 bp, Artificial
  Humanized antibody sequence
cagtcggtggaggagtccgggggtcgcctggtcacgcctgggacacccttgacactcacctgcacagtctctggactcaccattagtagctactacatgagctgggtccgccaggctccagggaaggggctggaatggatcggaaccattaatcctggtgctaacacatacttcgcgagctgggcaaaaggccgattcaccatctccagaacctcgaccacggtggatctgaaaatcaccagtccgacaaccgaggacacggccacatatttctgtgccagagagggggatagtaatgactggggtgtctttgacttgtggggccagggcaccctggtcaccgtctcgagc

SEQ ID NO: 93 - DNA, 87 bp, Artificial
  Humanized antibody sequence
cagtcggtggaggagtccgggggtcgcctggtcacgcctgggacacccttgacactcacctgcacagtctctggactcaccattagt

SEQ ID NO: 94 - DNA, 15 bp, Oryctolagus cuniculus
agctactacatgagc

SEQ ID NO: 95 - DNA, 42 bp, Artificial
  Humanized antibody sequence
tgggtccgccaggctccagggaaggggctggaatggatcgga

SEQ ID NO: 96 - DNA, 48 bp, Oryctolagus cuniculus
accattaatcctggtgctaacacatacttcgcgagctgggcaaaaggc

SEQ ID NO: 97 - DNA, 90 bp, Artificial
  Humanized antibody sequence
cgattcaccatctccagaacctcgaccacggtggatctgaaaatcaccagtccgacaaccgaggacacggccacatatttctgtgccaga

SEQ ID NO: 98 - DNA, 36 bp, Oryctolagus cuniculus
gagggggatagtaatgactggggtgtctttgacttg

SEQ ID NO: 99 - DNA, 33 bp, Artificial
  Humanized antibody sequence
tggggccagggcaccctggtcaccgtctcgagc

SEQ ID NO: 100 - DNA, 990 bp, Artificial; identical to SEQ ID NO: 20
  Humanized antibody sequence

SEQ ID NO: 101 - protein, 217 aa, Artificial
  Humanized antibody sequence
AYDMTQTPASVEIAVGGTVTIRCQASEDIESYLAWYQQKPGQPPKLLIYRASDLASGVSSRFKGSGSGTDYTLTISGVECDDAATYYCQQGYTIDNVDNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 111 aa, Artificial
  Humanized antibody sequence
AYDMTQTPASVEIAVGGTVTIRCQASEDIESYLAWYQQKPGQPPKLLIYRASDLASGVSSRFKGSGSGTDYTLTISGVECDDAATYYCQQGYTIDNVDNTFGGGTEVVVKR

SEQ ID NO: 103 - protein, 23 aa, Artificial
  Humanized antibody sequence
AYDMTQTPASVEIAVGGTVTIRC

SEQ ID NO: 104 - protein, 11 aa, Oryctolagus cuniculus
QASEDIESYLA

SEQ ID NO: 105 - protein, 15 aa, Artificial
  Humanized antibody sequence
WYQQKPGQPPKLLIY

SEQ ID NO: 106 - protein, 7 aa, Oryctolagus cuniculus
RASDLAS

SEQ ID NO: 107 - protein, 32 aa, Artificial
  Humanized antibody sequence
GVSSRFKGSGSGTDYTLTISGVECDDAATYYC

SEQ ID NO: 108 - protein, 12 aa, Oryctolagus cuniculus
QQGYTIDNVDNT

SEQ ID NO: 109 - protein, 11 aa, Artificial
  Humanized antibody sequence
FGGGTEVVVKR

SEQ ID NO: 110 - protein, 106 aa, Artificial; identical to SEQ ID NO: 30
  Humanized antibody sequence

SEQ ID NO: 111 - DNA, 651 bp, Artificial
  Humanized antibody sequence
gcctatgatatgacccagactccagcctctgtagagatagctgtgggaggcacagtcaccatcaggtgccaggccagtgaggacattgaaagctatttagcctggtatcagcagaaaccagggcagcctcccaaactcctgatctacagggcatccgatctggcatctggggtctcatcgcggttcaaaggcagtggatctgggacagactacactctcaccatcagcggcgtggagtgtgacgatgctgccacttactactgtcaacagggttatactatcgataatgttgataatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 112 - DNA, 333 bp, Artificial
  Humanized antibody sequence
gcctatgatatgacccagactccagcctctgtagagatagctgtgggaggcacagtcaccatcaggtgccaggccagtgaggacattgaaagctatttagcctggtatcagcagaaaccagggcagcctcccaaactcctgatctacagggcatccgatctggcatctggggtctcatcgcggttcaaaggcagtggatctgggacagactacactctcaccatcagcggcgtggagtgtgacgatgctgccacttactactgtcaacagggttatactatcgataatgttgataatactttcggcggagggaccgaggtggtggtcaaacgt

SEQ ID NO: 113 - DNA, 69 bp, Artificial
  Humanized antibody sequence
gcctatgatatgacccagactccagcctctgtagagatagctgtgggaggcacagtcaccatcaggtgc

SEQ ID NO: 114 - DNA, 33 bp, Oryctolagus cuniculus
caggccagtgaggacattgaaagctatttagcc

SEQ ID NO: 115 - DNA, 45 bp, Artificial
  Humanized antibody sequence
tggtatcagcagaaaccagggcagcctcccaaactcctgatctac

SEQ ID NO: 116 - DNA, 21 bp, Oryctolagus cuniculus
agggcatccgatctggcatct

SEQ ID NO: 117 - DNA, 96 bp, Artificial
  Humanized antibody sequence
ggggtctcatcgcggttcaaaggcagtggatctgggacagactacactctcaccatcagcggcgtggagtgtgacgatgctgccacttactactgt

SEQ ID NO: 118 - DNA, 36 bp, Oryctolagus cuniculus
caacagggttatactatcgataatgttgataatact

SEQ ID NO: 119 - DNA, 33 bp, Artificial; identical to SEQ ID NO: 39
  Humanized antibody sequence

SEQ ID NO: 120 - DNA, 318 bp, Artificial; identical to SEQ ID NO: 80
  Humanized antibody sequence

SEQ ID NO: 121 - protein, 447 aa, Artificial
  Humanized antibody sequence
QSLEESGGRLVQPGTPLTLSCTASGLTISSYYMSWVRQAPGKGLEWVGTINPGANTYFASSAKGRFTISRSSTTLDLKMTSPTAEDTATYYCAREGDSNDWGVFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 117 aa, Artificial
  Humanized antibody sequence
QSLEESGGRLVQPGTPLTLSCTASGLTISSYYMSWVRQAPGKGLEWVGTINPGANTYFASSAKGRFTISRSSTTLDLKMTSPTAEDTATYYCAREGDSNDWGVFDLWGQGTLVTVSS

SEQ ID NO: 123 - protein, 29 aa, Artificial
  Humanized antibody sequence
QSLEESGGRLVQPGTPLTLSCTASGLTIS

SEQ ID NO: 124 - protein, 5 aa, Oryctolagus cuniculus
SYYMS

SEQ ID NO: 125 - protein, 14 aa, Artificial
  Humanized antibody sequence
WVRQAPGKGLEWVG

SEQ ID NO: 126 - protein, 16 aa, Artificial
  Humanized antibody sequence
TINPGANTYFASSAKG

SEQ ID NO: 127 - protein, 30 aa, Artificial
  Humanized antibody sequence
RFTISRSSTTLDLKMTSPTAEDTATYYCAR

SEQ ID NO: 128 - protein, 12 aa, Oryctolagus cuniculus
EGDSNDWGVFDL

SEQ ID NO: 129 - protein, 11 aa, Artificial
  Humanized antibody sequence
WGQGTLVTVSS

SEQ ID NO: 130 - protein, 330 aa, Artificial; identical to SEQ ID NO: 10
  Humanized antibody sequence

SEQ ID NO: 131 - DNA, 1341 bp, Artificial
  Humanized antibody sequence
cagtcgctggaggagtctgggggacgcttggtccagcctgggacacccctgacactctcctgtacagcctctggactcaccattagtagctactacatgagctgggtccgtcaggctccagggaaggggctggagtgggtcggaaccatcaatcctggtgctaacacatacttcgcgagctctgcaaaaggccgattcaccatctccagatcctcgaccaccctggatcttaagatgaccagcccgacagctgaggacactgctacatattactgtgctagagagggggatagtaatgactggggtgtctttgacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 132 - DNA, 351 bp, Artificial
  Humanized antibody sequence
cagtcgctggaggagtctgggggacgcttggtccagcctgggacacccctgacactctcctgtacagcctctggactcaccattagtagctactacatgagctgggtccgtcaggctccagggaaggggctggagtgggtcggaaccatcaatcctggtgctaacacatacttcgcgagctctgcaaaaggccgattcaccatctccagatcctcgaccaccctggatcttaagatgaccagcccgacagctgaggacactgctacatattactgtgctagagagggggatagtaatgactggggtgtctttgacttgtggggccaagggaccctcgtcaccgtctcgagc

SEQ ID NO: 133 - DNA, 87 bp, Artificial
  Humanized antibody sequence
cagtcgctggaggagtctgggggacgcttggtccagcctgggacacccctgacactctcctgtacagcctctggactcaccattagt

SEQ ID NO: 134 - DNA, 15 bp, Oryctolagus cuniculus
agctactacatgagc

SEQ ID NO: 135 - DNA, 42 bp, Artificial
  Humanized antibody sequence
tgggtccgtcaggctccagggaaggggctggagtgggtcgga

SEQ ID NO: 136 - DNA, 48 bp, Artificial
  Humanized antibody sequence
accatcaatcctggtgctaacacatacttcgcgagctctgcaaaaggc

SEQ ID NO: 137 - DNA, 90 bp, Artificial
  Humanized antibody sequence
cgattcaccatctccagatcctcgaccaccctggatcttaagatgaccagcccgacagctgaggacactgctacatattactgtgctaga

SEQ ID NO: 138 - DNA, 36 bp, Oryctolagus cuniculus; identical to SEQ ID NO: 98

SEQ ID NO: 139 - DNA, 33 bp, Artificial; identical to SEQ ID NO: 59
  Humanized antibody sequence

SEQ ID NO: 140 - DNA, 990 bp, Artificial; identical to SEQ ID NO: 20
  Humanized antibody sequence

SEQ ID NO: 141 - protein, 217 aa, Artificial
  Humanized antibody sequence
AYDMTQSPASVEAAVGGTVTIRCQASEDIESYLAWYQQKPGQPPKLLIYRASDLASGVSSRFKGSGSGTDYTLTISGLEPEDAATYYCQQGYTIDNVDNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 111 aa, Artificial
  Humanized antibody sequence
AYDMTQSPASVEAAVGGTVTIRCQASEDIESYLAWYQQKPGQPPKLLIYRASDLASGVSSRFKGSGSGTDYTLTISGLEPEDAATYYCQQGYTIDNVDNTFGGGTKVEIKR

SEQ ID NO: 143 - protein, 23 aa, Artificial
  Humanized antibody sequence
AYDMTQSPASVEAAVGGTVTIRC

SEQ ID NO: 144 - protein, 11 aa, Oryctolagus cuniculus
QASEDIESYLA

SEQ ID NO: 145 - protein, 15 aa, Artificial
  Humanized antibody sequence
WYQQKPGQPPKLLIY

SEQ ID NO: 146 - protein, 7 aa, Oryctolagus cuniculus
RASDLAS

SEQ ID NO: 147 - protein, 32 aa, Artificial
  Humanized antibody sequence
GVSSRFKGSGSGTDYTLTISGLEPEDAATYYC

SEQ ID NO: 148 - protein, 12 aa, Oryctolagus cuniculus
QQGYTIDNVDNT

SEQ ID NO: 149 - protein, 11 aa, Artificial
  Humanized antibody sequence
FGGGTKVEIKR

SEQ ID NO: 150 - protein, 106 aa, Artificial; identical to SEQ ID NO: 30
  Humanized antibody sequence

SEQ ID NO: 151 - DNA, 651 bp, Artificial
  Humanized antibody sequence
gcctatgatatgacccagtctccagcctccgtggaggcagccgtaggaggcacagtcaccatcaggtgtcaggccagtgaggacattgaaagctacttagcctggtatcagcagaaaccagggcagcctcctaagctcctgatctatagggcatccgatctggcatctggggtctcatcaaggttcaaaggcagtggatctgggacagattacactctcaccatcagcggcctggagcctgaagatgctgcaacttactattgtcaacagggttatactatcgataatgttgacaatactttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 152 - DNA, 333 bp, Artificial
  Humanized antibody sequence
gcctatgatatgacccagtctccagcctccgtggaggcagccgtaggaggcacagtcaccatcaggtgtcaggccagtgaggacattgaaagctacttagcctggtatcagcagaaaccagggcagcctcctaagctcctgatctatagggcatccgatctggcatctggggtctcatcaaggttcaaaggcagtggatctgggacagattacactctcaccatcagcggcctggagcctgaagatgctgcaacttactattgtcaacagggttatactatcgataatgttgacaatactttcggcggaggaaccaaggtggaaatcaaacgt

SEQ ID NO: 153 - DNA, 69 bp, Artificial
  Humanized antibody sequence
gcctatgatatgacccagtctccagcctccgtggaggcagccgtaggaggcacagtcaccatcaggtgt

SEQ ID NO: 154 - DNA, 33 bp, Oryctolagus cuniculus
caggccagtgaggacattgaaagctacttagcc

SEQ ID NO: 155 - DNA, 45 bp, Artificial
  Humanized antibody sequence
tggtatcagcagaaaccagggcagcctcctaagctcctgatctat

SEQ ID NO: 156 - DNA, 21 bp, Oryctolagus cuniculus
agggcatccgatctggcatct

SEQ ID NO: 157 - DNA, 96 bp, Artificial
  Humanized antibody sequence
ggggtctcatcaaggttcaaaggcagtggatctgggacagattacactctcaccatcagcggcctggagcctgaagatgctgcaacttactattgt

SEQ ID NO: 158 - DNA, 36 bp, Oryctolagus cuniculus
caacagggttatactatcgataatgttgacaatact

SEQ ID NO: 159 - DNA, 33 bp, Artificial; identical to SEQ ID NO: 79
  Humanized antibody sequence

SEQ ID NO: 160 - DNA, 318 bp, Artificial; identical to SEQ ID NO: 80
  Humanized antibody sequence

SEQ ID NO: 161 - protein, 443 aa, Artificial
  Humanized antibody sequence
QSLEESGGRLVTPGTPLTLTCTVSGFSLNNYAVGWVRQAPGKGLEWIGIIYLSGNTDYANWAKGRFTISKTSTTVDLKITSPTTEDTATYFCARKFDTGYDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 113 aa, Artificial
  Humanized antibody sequence
QSLEESGGRLVTPGTPLTLTCTVSGFSLNNYAVGWVRQAPGKGLEWIGIIYLSGNTDYANWAKGRFTISKTSTTVDLKITSPTTEDTATYFCARKFDTGYDIWGPGTLVTVSS

SEQ ID NO: 163 - protein, 29 aa, Oryctolagus cuniculus
QSLEESGGRLVTPGTPLTLTCTVSGFSLN

SEQ ID NO: 164 - protein, 5 aa, Oryctolagus cuniculus
NYAVG

SEQ ID NO: 165 - protein, 14 aa, Oryctolagus cuniculus
WVRQAPGKGLEWIG

SEQ ID NO: 166 - protein, 16 aa, Oryctolagus cuniculus
IIYLSGNTDYANWAKG

SEQ ID NO: 167 - protein, 30 aa, Oryctolagus cuniculus
RFTISKTSTTVDLKITSPTTEDTATYFCAR

SEQ ID NO: 168 - protein, 8 aa, Oryctolagus cuniculus
KFDTGYDI

SEQ ID NO: 169 - protein, 11 aa, Artificial
  Humanized antibody sequence
WGPGTLVTVSS

SEQ ID NO: 170 - protein, 330 aa, Artificial; identical to SEQ ID NO: 10
  Humanized antibody sequence

SEQ ID NO: 171 - DNA, 1329 bp, Artificial
  Humanized antibody sequence
cagtcgctggaggagtccgggggtcgcctggtcacgcctgggacacccctgacactcacctgcacagtctctggattctccctcaataattatgcagtgggctgggtccgccaggctccagggaaggggctggaatggatcggaatcatttaccttagtggtaacacagactacgcgaactgggcgaaaggccgattcaccatctccaaaacctcgaccacggtggatctgaaaatcaccagtccgacaaccgaggacacggccacctatttctgtgccaggaaatttgatacgggatatgacatctggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 172 - DNA, 339 bp, Artificial
  Humanized antibody sequence
cagtcgctggaggagtccgggggtcgcctggtcacgcctgggacacccctgacactcacctgcacagtctctggattctccctcaataattatgcagtgggctgggtccgccaggctccagggaaggggctggaatggatcggaatcatttaccttagtggtaacacagactacgcgaactgggcgaaaggccgattcaccatctccaaaacctcgaccacggtggatctgaaaatcaccagtccgacaaccgaggacacggccacctatttctgtgccaggaaatttgatacgggatatgacatctggggcccaggcaccctcgtcaccgtctcgagc

SEQ ID NO: 173 - DNA, 87 bp, Oryctolagus cuniculus
cagtcgctggaggagtccgggggtcgcctggtcacgcctgggacacccctgacactcacctgcacagtctctggattctccctcaat

SEQ ID NO: 174 - DNA, 15 bp, Oryctolagus cuniculus
aattatgcagtgggc

SEQ ID NO: 175 - DNA, 42 bp, Oryctolagus cuniculus; identical to SEQ ID NO: 95

SEQ ID NO: 176 - DNA, 48 bp, Oryctolagus cuniculus
atcatttaccttagtggtaacacagactacgcgaactgggcgaaaggc

SEQ ID NO: 177 - DNA, 90 bp, Oryctolagus cuniculus
cgattcaccatctccaaaacctcgaccacggtggatctgaaaatcaccagtccgacaaccgaggacacggccacctatttctgtgccagg

SEQ ID NO: 178 - DNA, 24 bp, Oryctolagus cuniculus
aaatttgatacgggatatgacatc

SEQ ID NO: 179 - DNA, 33 bp, Artificial
  Humanized antibody sequence
tggggcccaggcaccctcgtcaccgtctcgagc

SEQ ID NO: 180 - DNA, 990 bp, Artificial; identical to SEQ ID NO: 20
  Humanized antibody sequence

SEQ ID NO: 181 - protein, 217 aa, Artificial
  Humanized antibody sequence
AYDMTQTPASMEVAVGGTVTIKCQASQSISTYLAWYQQKPGQPPKLLIYDASDLASGVSSRFKGSGSGTQFTLTISGVECDDAATYYCQQDWSDSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 111 aa, Artificial
  Humanized antibody sequence
AYDMTQTPASMEVAVGGTVTIKCQASQSISTYLAWYQQKPGQPPKLLIYDASDLASGVSSRFKGSGSGTQFTLTISGVECDDAATYYCQQDWSDSNVDNAFGGGTEVVVKR

SEQ ID NO: 183 - protein, 23 aa, Oryctolagus cuniculus
AYDMTQTPASMEVAVGGTVTIKC

SEQ ID NO: 184 - protein, 11 aa, Oryctolagus cuniculus
QASQSISTYLA

SEQ ID NO: 185 - protein, 15 aa, Oryctolagus cuniculus
WYQQKPGQPPKLLIY

SEQ ID NO: 186 - protein, 7 aa, Oryctolagus cuniculus
DASDLAS

SEQ ID NO: 187 - protein, 32 aa, Oryctolagus cuniculus
GVSSRFKGSGSGTQFTLTISGVECDDAATYYC

SEQ ID NO: 188 - protein, 12 aa, Oryctolagus cuniculus
QQDWSDSNVDNA

SEQ ID NO: 189 - protein, 11 aa, Artificial
  Humanized antibody sequence
FGGGTEVVVKR

SEQ ID NO: 190 - protein, 106 aa, Artificial; identical to SEQ ID NO: 30
  Humanized antibody sequence

SEQ ID NO: 191 - DNA, 651 bp, Artificial
  Humanized antibody sequence
gcctatgatatgacccagactccagcctctatggaggtagctgtgggaggcacagtcaccatcaagtgccaggccagtcagagcattagtacctacttagcctggtatcagcagaaaccagggcagcctcccaagctcctgatctatgatgcatccgatctggcatctggggtctcatcgcggttcaaaggcagtggatctgggacacagttcactctcaccatcagcggcgtggagtgtgacgatgctgccacttactactgtcaacaggattggagtgatagtaatgttgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 192 - DNA, 333 bp, Artificial
  Humanized antibody sequence
gcctatgatatgacccagactccagcctctatggaggtagctgtgggaggcacagtcaccatcaagtgccaggccagtcagagcattagtacctacttagcctggtatcagcagaaaccagggcagcctcccaagctcctgatctatgatgcatccgatctggcatctggggtctcatcgcggttcaaaggcagtggatctgggacacagttcactctcaccatcagcggcgtggagtgtgacgatgctgccacttactactgtcaacaggattggagtgatagtaatgttgataatgctttcggcggagggaccgaggtggtggtcaaacgt

SEQ ID NO: 193 - DNA, 69 bp, Oryctolagus cuniculus
gcctatgatatgacccagactccagcctctatggaggtagctgtgggaggcacagtcaccatcaagtgc

SEQ ID NO: 194 - DNA, 33 bp, Oryctolagus cuniculus
caggccagtcagagcattagtacctacttagcc

SEQ ID NO: 195 - DNA, 45 bp, Oryctolagus cuniculus
tggtatcagcagaaaccagggcagcctcccaagctcctgatctat

SEQ ID NO: 196 - DNA, 21 bp, Oryctolagus cuniculus
gatgcatccgatctggcatct

SEQ ID NO: 197 - DNA, 96 bp, Oryctolagus cuniculus
ggggtctcatcgcggttcaaaggcagtggatctgggacacagttcactctcaccatcagcggcgtggagtgtgacgatgctgccacttactactgt

SEQ ID NO: 198 - DNA, 36 bp, Oryctolagus cuniculus
caacaggattggagtgatagtaatgttgataatgct

SEQ ID NO: 199 - DNA, 33 bp, Artificial; identical to SEQ ID NO: 39
  Humanized antibody sequence

SEQ ID NO: 200 - DNA, 318 bp, Artificial; identical to SEQ ID NO: 80
  Humanized antibody sequence

SEQ ID NO: 201 - protein, 446 aa, Artificial
  Humanized antibody sequence
QSVEESGGRLVMPGTPLTLTCTVSGFSLSSNAISWVRQAPEKGLEWIGVIYVIGVTDYASWAQGRFTISKTSTTVDLKIPSPTTEDTATYFCARVYDSGWNHFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 116 aa, Artificial
  Humanized antibody sequence
QSVEESGGRLVMPGTPLTLTCTVSGFSLSSNAISWVRQAPEKGLEWIGVIYVIGVTDYASWAQGRFTISKTSTTVDLKIPSPTTEDTATYFCARVYDSGWNHFNLWGPGTLVTVSS

SEQ ID NO: 203 - protein, 29 aa, Oryctolagus cuniculus
QSVEESGGRLVMPGTPLTLTCTVSGFSLS

SEQ ID NO: 204 - protein, 5 aa, Oryctolagus cuniculus
SNAIS

SEQ ID NO: 205 - protein, 14 aa, Oryctolagus cuniculus
WVRQAPEKGLEWIG

SEQ ID NO: 206 - protein, 16 aa, Oryctolagus cuniculus
VIYVIGVTDYASWAQG

SEQ ID NO: 207 - protein, 30 aa, Oryctolagus cuniculus
RFTISKTSTTVDLKIPSPTTEDTATYFCAR

SEQ ID NO: 208 - protein, 11 aa, Oryctolagus cuniculus
VYDSGWNHFNL

SEQ ID NO: 209 - protein, 11 aa, Artificial
  Humanized antibody sequence
WGPGTLVTVSS

SEQ ID NO: 210 - protein, 330 aa, Artificial; identical to SEQ ID NO: 10
  Humanized antibody sequence

SEQ ID NO: 211 - DNA, 1338 bp, Artificial
  Humanized antibody sequence
cagtcggtggaggagtccgggggtcgcctggtcatgcctgggacacccctgacactcacctgcaccgtctctggattctccctcagtagcaatgcaataagctgggtccgccaggctccagagaaggggctggaatggatcggagtcatttatgttattggtgtcactgactacgcgagctgggcgcaaggccgattcaccatctccaaaacctcgaccacggtggatctgaaaatccccagtccgacaaccgaggacacggccacctatttctgtgccagagtttatgattctggctggaatcactttaacttgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 212 - DNA, 348 bp, Artificial
  Humanized antibody sequence
cagtcggtggaggagtccgggggtcgcctggtcatgcctgggacacccctgacactcacctgcaccgtctctggattctccctcagtagcaatgcaataagctgggtccgccaggctccagagaaggggctggaatggatcggagtcatttatgttattggtgtcactgactacgcgagctgggcgcaaggccgattcaccatctccaaaacctcgaccacggtggatctgaaaatccccagtccgacaaccgaggacacggccacctatttctgtgccagagtttatgattctggctggaatcactttaacttgtggggcccgggcaccctcgtcaccgtctcgagc

SEQ ID NO: 213 - DNA, 87 bp, Oryctolagus cuniculus
cagtcggtggaggagtccgggggtcgcctggtcatgcctgggacacccctgacactcacctgcaccgtctctggattctccctcagt

SEQ ID NO: 214 - DNA, 15 bp, Oryctolagus cuniculus
agcaatgcaataagc

SEQ ID NO: 215 - DNA, 42 bp, Oryctolagus cuniculus
tgggtccgccaggctccagagaaggggctggaatggatcgga

SEQ ID NO: 216 - DNA, 48 bp, Oryctolagus cuniculus
gtcatttatgttattggtgtcactgactacgcgagctgggcgcaaggc

SEQ ID NO: 217 - DNA, 90 bp, Oryctolagus cuniculus
cgattcaccatctccaaaacctcgaccacggtggatctgaaaatccccagtccgacaaccgaggacacggccacctatttctgtgccaga

SEQ ID NO: 218 - DNA, 33 bp, Oryctolagus cuniculus
gtttatgattctggctggaatcactttaacttg

SEQ ID NO: 219 - DNA, 33 bp, Artificial
  Humanized antibody sequence
tggggcccgggcaccctcgtcaccgtctcgagc

SEQ ID NO: 220 - DNA, 990 bp, Artificial; identical to SEQ ID NO: 20
  Humanized antibody sequence

SEQ ID NO: 221 - protein, 222 aa, Artificial
  Humanized antibody sequence
ADIVMTQTPSSVEAAVGGTVTIKCQASENIYRLLAWYQQKPGQRPKLLIYSASTLASGVPSRFKGSGSGTQFTLTISDLECADAATYYCQNYYYSSRSSYDTYNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 116 aa, Artificial
  Humanized antibody sequence
ADIVMTQTPSSVEAAVGGTVTIKCQASENIYRLLAWYQQKPGQRPKLLIYSASTLASGVPSRFKGSGSGTQFTLTISDLECADAATYYCQNYYYSSRSSYDTYNVFGGGTEVVVKR

SEQ ID NO: 223 - protein, 24 aa, Oryctolagus cuniculus
ADIVMTQTPSSVEAAVGGTVTIKC

SEQ ID NO: 224 - protein, 11 aa, Oryctolagus cuniculus
QASENIYRLLA

SEQ ID NO: 225 - protein, 15 aa, Oryctolagus cuniculus
WYQQKPGQRPKLLIY

SEQ ID NO: 226 - protein, 7 aa, Oryctolagus cuniculus
SASTLAS

SEQ ID NO: 227 - protein, 32 aa, Oryctolagus cuniculus
GVPSRFKGSGSGTQFTLTISDLECADAATYYC

SEQ ID NO: 228 - protein, 16 aa, Oryctolagus cuniculus
QNYYYSSRSSYDTYNV

SEQ ID NO: 229 - protein, 11 aa, Artificial
  Humanized antibody sequence
FGGGTEVVVKR

SEQ ID NO: 230 - protein, 106 aa, Artificial; identical to SEQ ID NO: 30
  Humanized antibody sequence

SEQ ID NO: 231 - DNA, 666 bp, Artificial
  Humanized antibody sequence
gctgacattgtgatgacccagactccatcctccgtggaggcagctgtgggaggcacagtcaccatcaagtgccaggccagtgagaacatttataggttattggcctggtatcagcagaaaccagggcagcgtcccaagctcctgatctattctgcatccactctggcatctggggtcccatcgcggttcaaaggcagtggatctgggacacagttcactctcaccatcagcgacctggagtgtgccgatgctgccacttactactgtcaaaactattattatagtagtaggagtagttatgatacatataatgttttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 232 - DNA, 348 bp, Artificial
  Humanized antibody sequence
gctgacattgtgatgacccagactccatcctccgtggaggcagctgtgggaggcacagtcaccatcaagtgccaggccagtgagaacatttataggttattggcctggtatcagcagaaaccagggcagcgtcccaagctcctgatctattctgcatccactctggcatctggggtcccatcgcggttcaaaggcagtggatctgggacacagttcactctcaccatcagcgacctggagtgtgccgatgctgccacttactactgtcaaaactattattatagtagtaggagtagttatgatacatataatgttttcggcggagggaccgaggtggtggtcaaacgt

SEQ ID NO: 233 - DNA, 72 bp, Oryctolagus cuniculus
gctgacattgtgatgacccagactccatcctccgtggaggcagctgtgggaggcacagtcaccatcaagtgc

SEQ ID NO: 234 - DNA, 33 bp, Oryctolagus cuniculus
caggccagtgagaacatttataggttattggcc

SEQ ID NO: 235 - DNA, 45 bp, Oryctolagus cuniculus
tggtatcagcagaaaccagggcagcgtcccaagctcctgatctat

SEQ ID NO: 236 - DNA, 21 bp, Oryctolagus cuniculus
tctgcatccactctggcatct

SEQ ID NO: 237 - DNA, 96 bp, Oryctolagus cuniculus
ggggtcccatcgcggttcaaaggcagtggatctgggacacagttcactctcaccatcagcgacctggagtgtgccgatgctgccacttactactgt

SEQ ID NO: 238 - DNA, 48 bp, Oryctolagus cuniculus
caaaactattattatagtagtaggagtagttatgatacatataatgtt

SEQ ID NO: 239 - DNA, 33 bp, Artificial; identical to SEQ ID NO: 39
  Humanized antibody sequence

SEQ ID NO: 240 - DNA, 318 bp, Artificial; identical to SEQ ID NO: 80
  Humanized antibody sequence

SEQ ID NO: 241 - protein, 446 aa, Artificial; identical to SEQ ID NO: 201
  Humanized antibody sequence

SEQ ID NO: 242 - protein, 116 aa, Artificial; identical to SEQ ID NO: 202
  Humanized antibody sequence

SEQ ID NO: 243 - protein, 29 aa, Oryctolagus cuniculus
QSVEESGGRLVMPGTPLTLTCTVSGFSLS

SEQ ID NO: 244 - protein, 5 aa, Oryctolagus cuniculus
SNAIS

SEQ ID NO: 245 - protein, 14 aa, Oryctolagus cuniculus
WVRQAPEKGLEWIG

SEQ ID NO: 246 - protein, 16 aa, Oryctolagus cuniculus
VIYVIGVTDYASWAQG

SEQ ID NO: 247 - protein, 30 aa, Oryctolagus cuniculus; identical to SEQ ID NO: 207

SEQ ID NO: 248 - protein, 11 aa, Oryctolagus cuniculus
VYDSGWNHFNL

SEQ ID NO: 249 - protein, 11 aa, Artificial
  Humanized antibody sequence
WGPGTLVTVSS

SEQ ID NO: 250 - protein, 330 aa, Artificial; identical to SEQ ID NO: 10
  Humanized antibody sequence

SEQ ID NO: 251 - DNA, 1338 bp, Artificial
  Humanized antibody sequence
cagtcggtggaggagtccgggggtcgcctggtcatgcctgggacacccctgacactcacctgcaccgtctctggattctccctcagtagcaatgcaataagctgggtccgccaggctccagagaaggggctggaatggatcggagtcatttatgttattggtgtcactgactacgcgagctgggcgcaaggccgattcaccatctccaaaacctcgaccacggtggatctgaaaatccccagtccgacaaccgaggacacggccacctatttctgtgccagagtttatgattctggctggaatcactttaacttgtggggcccagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 252 - DNA, 348 bp, Artificial
  Humanized antibody sequence
cagtcggtggaggagtccgggggtcgcctggtcatgcctgggacacccctgacactcacctgcaccgtctctggattctccctcagtagcaatgcaataagctgggtccgccaggctccagagaaggggctggaatggatcggagtcatttatgttattggtgtcactgactacgcgagctgggcgcaaggccgattcaccatctccaaaacctcgaccacggtggatctgaaaatccccagtccgacaaccgaggacacggccacctatttctgtgccagagtttatgattctggctggaatcactttaacttgtggggcccagggaccctcgtcaccgtctcgagc

SEQ ID NO: 253 - DNA, 87 bp, Oryctolagus cuniculus; identical to SEQ ID NO: 213

SEQ ID NO: 254 - DNA, 15 bp, Oryctolagus cuniculus
agcaatgcaataagc

SEQ ID NO: 255 - DNA, 42 bp, Oryctolagus cuniculus; identical to SEQ ID NO: 215

SEQ ID NO: 256 - DNA, 48 bp, Oryctolagus cuniculus; identical to SEQ ID NO: 216

SEQ ID NO: 257 - DNA, 90 bp, Oryctolagus cuniculus; identical to SEQ ID NO: 217

SEQ ID NO: 258 - DNA, 33 bp, Oryctolagus cuniculus; identical to SEQ ID NO: 218

SEQ ID NO: 259 - DNA, 33 bp, Artificial
  Humanized antibody sequence
tggggcccagggaccctcgtcaccgtctcgagc

SEQ ID NO: 260 - DNA, 990 bp, Artificial; identical to SEQ ID NO: 20
  Humanized antibody sequence

SEQ ID NO: 261 - protein, 217 aa, Artificial
  Humanized antibody sequence
AYDMTQTPASVEVAVGGTVTIKCQASQSISSWLAWYQQKPGQPPKLLIYEASKLASGVPSRFSGSGSGTQFTLTISGVECADAATYYCQQAYSVANVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 111 aa, Artificial
  Humanized antibody sequence
AYDMTQTPASVEVAVGGTVTIKCQASQSISSWLAWYQQKPGQPPKLLIYEASKLASGVPSRFSGSGSGTQFTLTISGVECADAATYYCQQAYSVANVDNAFGGGTEVVVKR

SEQ ID NO: 263 - protein, 23 aa, Oryctolagus cuniculus
AYDMTQTPASVEVAVGGTVTIKC

SEQ ID NO: 264 - protein, 11 aa, Oryctolagus cuniculus
QASQSISSWLA

SEQ ID NO: 265 - protein, 15 aa, Oryctolagus cuniculus
WYQQKPGQPPKLLIY

SEQ ID NO: 266 - protein, 7 aa, Oryctolagus cuniculus
EASKLAS

SEQ ID NO: 267 - protein, 32 aa, Oryctolagus cuniculus
GVPSRFSGSGSGTQFTLTISGVECADAATYYC

SEQ ID NO: 268 - protein, 12 aa, Oryctolagus cuniculus
QQAYSVANVDNA

SEQ ID NO: 269 - protein, 11 aa, Artificial
  Humanized antibody sequence
FGGGTEVVVKR

SEQ ID NO: 270 - protein, 106 aa, Artificial; identical to SEQ ID NO: 30
  Humanized antibody sequence

SEQ ID NO: 271 - DNA, 651 bp, Artificial
  Humanized antibody sequence
gcctatgatatgacccagactccagcctctgtggaggtagctgtgggaggcacagtcaccatcaagtgccaggccagtcagagcattagcagttggttagcctggtatcagcagaaaccagggcagcctccaaagctcctgatctacgaagcatccaaactggcatctggggtcccatcgcggttcagtggcagtggatctgggacacagttcactctcaccatcagcggcgtggagtgtgccgatgctgccacttactactgtcaacaggcttatagtgttgccaatgttgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 272 - DNA, 333 bp, Artificial
  Humanized antibody sequence
gcctatgatatgacccagactccagcctctgtggaggtagctgtgggaggcacagtcaccatcaagtgccaggccagtcagagcattagcagttggttagcctggtatcagcagaaaccagggcagcctccaaagctcctgatctacgaagcatccaaactggcatctggggtcccatcgcggttcagtggcagtggatctgggacacagttcactctcaccatcagcggcgtggagtgtgccgatgctgccacttactactgtcaacaggcttatagtgttgccaatgttgataatgctttcggcggagggaccgaggtggtggtcaaacgt

SEQ ID NO: 273 - DNA, 69 bp, Oryctolagus cuniculus
gcctatgatatgacccagactccagcctctgtggaggtagctgtgggaggcacagtcaccatcaagtgc

SEQ ID NO: 274 - DNA, 33 bp, Oryctolagus cuniculus; identical to SEQ ID NO: 34

SEQ ID NO: 275 - DNA, 45 bp, Oryctolagus cuniculus
tggtatcagcagaaaccagggcagcctccaaagctcctgatctac

SEQ ID NO: 276 - DNA, 21 bp, Oryctolagus cuniculus
gaagcatccaaactggcatct

SEQ ID NO: 277 - DNA, 96 bp, Oryctolagus cuniculus
ggggtcccatcgcggttcagtggcagtggatctgggacacagttcactctcaccatcagcggcgtggagtgtgccgatgctgccacttactactgt

SEQ ID NO: 278 - DNA, 36 bp, Oryctolagus cuniculus
caacaggcttatagtgttgccaatgttgataatgct

SEQ ID NO: 279 - DNA, 33 bp, Artificial; identical to SEQ ID NO: 39
  Humanized antibody sequence

SEQ ID NO: 280 - DNA, 318 bp, Artificial; identical to SEQ ID NO: 80
  Humanized antibody sequence

SEQ ID NO: 281 - protein, 449 aa, Artificial
  Humanized antibody sequence
EVQLVESGGGLVQPGGSLRLSCAASGFTVSSNAISWVRQAPGKGLEWVGVIYVIGVTDYASSAQGRFTISRDNSKNTLYLQMNSLRAEDTAVYYCARVYDSGWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 119 aa, Artificial
  Humanized antibody sequence
EVQLVESGGGLVQPGGSLRLSCAASGFTVSSNAISWVRQAPGKGLEWVGVIYVIGVTDYASSAQGRFTISRDNSKNTLYLQMNSLRAEDTAVYYCARVYDSGWNHFNLWGQGTLVTVSS

SEQ ID NO: 283 - protein, 30 aa, Artificial; identical to SEQ ID NO: 43
  Humanized antibody sequence

SEQ ID NO: 284 - protein, 5 aa, Oryctolagus cuniculus
SNAIS

SEQ ID NO: 285 - protein, 14 aa, Artificial
  Humanized antibody sequence
WVRQAPGKGLEWVG

SEQ ID NO: 286 - protein, 16 aa, Artificial
  Humanized antibody sequence
VIYVIGVTDYASSAQG

SEQ ID NO: 287 - protein, 32 aa, Artificial; identical to SEQ ID NO: 47
  Humanized antibody sequence

SEQ ID NO: 288 - protein, 11 aa, Oryctolagus cuniculus
VYDSGWNHFNL

SEQ ID NO: 289 - protein, 11 aa, Artificial
  Humanized antibody sequence
WGQGTLVTVSS

SEQ ID NO: 290 - protein, 330 aa, Artificial; identical to SEQ ID NO: 10
  Humanized antibody sequence

SEQ ID NO: 291 - DNA, 1347 bp, Artificial
  Humanized antibody sequence
gaggtgcagctggtggagtctgggggaggcttggtccagcctggggggtccctgagactctcctgtgcagcctctggattcaccgtcagtagcaatgcaataagctgggtccgtcaggctccagggaaggggctggagtgggtcggagtcatttatgttattggtgtcactgactacgcgagctctgcgcaaggccgattcaccatctccagagacaattccaagaacaccctgtatcttcaaatgaacagcctgagagctgaggacactgctgtgtattactgtgctagagtttatgattctggctggaatcactttaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 292 - DNA, 357 bp, Artificial
  Humanized antibody sequence
gaggtgcagctggtggagtctgggggaggcttggtccagcctggggggtccctgagactctcctgtgcagcctctggattcaccgtcagtagcaatgcaataagctgggtccgtcaggctccagggaaggggctggagtgggtcggagtcatttatgttattggtgtcactgactacgcgagctctgcgcaaggccgattcaccatctccagagacaattccaagaacaccctgtatcttcaaatgaacagcctgagagctgaggacactgctgtgtattactgtgctagagtttatgattctggctggaatcactttaacttgtggggccaagggaccctcgtcaccgtctcgagc

SEQ ID NO: 293 - DNA, 90 bp, Artificial; identical to SEQ ID NO: 53
  Humanized antibody sequence

SEQ ID NO: 294 - DNA, 15 bp, Oryctolagus cuniculus
agcaatgcaataagc

SEQ ID NO: 295 - DNA, 42 bp, Artificial; identical to SEQ ID NO: 135
  Humanized antibody sequence

SEQ ID NO: 296 - DNA, 48 bp, Artificial
  Humanized antibody sequence
gtcatttatgttattggtgtcactgactacgcgagctctgcgcaaggc

SEQ ID NO: 297 - DNA, 96 bp, Artificial; identical to SEQ ID NO: 57
  Humanized antibody sequence

SEQ ID NO: 298 - DNA, 33 bp, Oryctolagus cuniculus; identical to SEQ ID NO: 218

SEQ ID NO: 299 - DNA, 33 bp, Artificial; identical to SEQ ID NO: 59
  Humanized antibody sequence

SEQ ID NO: 300 - DNA, 990 bp, Artificial; identical to SEQ ID NO: 20
  Humanized antibody sequence

SEQ ID NO: 301 - protein, 217 aa, Artificial
  Humanized antibody sequence
DIQMTQSPSTLSASVGDRVTITCQASQSISSWLAWYQQKPGKAPKLLIYEASKLASGVPSRFSGSGSGTEFTLTISSLQPDDFATYYCQQAYSVANVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 111 aa, Artificial
  Humanized antibody sequence
DIQMTQSPSTLSASVGDRVTITCQASQSISSWLAWYQQKPGKAPKLLIYEASKLASGVPSRFSGSGSGTEFTLTISSLQPDDFATYYCQQAYSVANVDNAFGGGTKVEIKR

SEQ ID NO: 303 - protein, 23 aa, Artificial
  Humanized antibody sequence
DIQMTQSPSTLSASVGDRVTITC

SEQ ID NO: 304 - protein, 11 aa, Oryctolagus cuniculus
QASQSISSWLA

SEQ ID NO: 305 - protein, 15 aa, Artificial
  Humanized antibody sequence
WYQQKPGKAPKLLIY

SEQ ID NO: 306 - protein, 7 aa, Oryctolagus cuniculus
EASKLAS

SEQ ID NO: 307 - protein, 32 aa, Artificial; identical to SEQ ID NO: 67
  Humanized antibody sequence

SEQ ID NO: 308 - protein, 12 aa, Oryctolagus cuniculus
QQAYSVANVDNA

SEQ ID NO: 309 - protein, 11 aa, Artificial
  Humanized antibody sequence
FGGGTKVEIKR

SEQ ID NO: 310 - protein, 106 aa, Artificial; identical to SEQ ID NO: 30
  Humanized antibody sequence

SEQ ID NO: 311 - DNA, 651 bp, Artificial
  Humanized antibody sequence
gacatccagatgacccagtctccttccaccctgtctgcatctgtaggagacagagtcaccatcacttgccaggccagtcagagcattagcagttggttagcctggtatcagcagaaaccaggaaaagcccctaagctcctgatctatgaagcatccaaactggcatctggagtcccatcaaggttcagcggcagtggatctggaacagaattcactctcaccatcagcagcctgcagcctgatgattttgcaacttattactgccaacaggcttatagtgttgccaatgttgataatgctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 312 - DNA, 333 bp, Artificial
  Humanized antibody sequence
gacatccagatgacccagtctccttccaccctgtctgcatctgtaggagacagagtcaccatcacttgccaggccagtcagagcattagcagttggttagcctggtatcagcagaaaccaggaaaagcccctaagctcctgatctatgaagcatccaaactggcatctggagtcccatcaaggttcagcggcagtggatctggaacagaattcactctcaccatcagcagcctgcagcctgatgattttgcaacttattactgccaacaggcttatagtgttgccaatgttgataatgctttcggcggaggaaccaaggtggaaatcaaacgt

SEQ ID NO: 313 - DNA, 69 bp, Artificial; identical to SEQ ID NO: 73
  Humanized antibody sequence

SEQ ID NO: 314 - DNA, 33 bp, Oryctolagus cuniculus; identical to SEQ ID NO: 34

SEQ ID NO: 315 - DNA, 45 bp, Artificial; identical to SEQ ID NO: 75
  Humanized antibody sequence

SEQ ID NO: 316 - DNA, 21 bp, Oryctolagus cuniculus
gaagcatccaaactggcatct

SEQ ID NO: 317 - DNA, 96 bp, Artificial; identical to SEQ ID NO: 77
  Humanized antibody sequence

SEQ ID NO: 318 - DNA, 36 bp, Oryctolagus cuniculus; identical to SEQ ID NO: 278

SEQ ID NO: 319 - DNA, 33 bp, Artificial; identical to SEQ ID NO: 79
  Humanized antibody sequence

SEQ ID NO: 320 - DNA, 318 bp, Artificial; identical to SEQ ID NO: 80
  Humanized antibody sequence

SEQ ID NO: 321 - protein, 450 aa, Artificial
  Humanized antibody sequence
QSVEESGGRLVTPGTPLTLTCTVSGIDLNSNGMSWVRQAPGEGLEWIGASSIDGTTYYTNWAKGRFTISKTSSTTVDLKITSPTTEDTATYFCTRGEYAGVVGSNYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - protein, 120 aa, Artificial
  Humanized antibody sequence
QSVEESGGRLVTPGTPLTLTCTVSGIDLNSNGMSWVRQAPGEGLEWIGASSIDGTTYYTNWAKGRFTISKTSSTTVDLKITSPTTEDTATYFCTRGEYAGVVGSNYFDLWGQGTLVTVSS

SEQ ID NO: 323 - protein, 29 aa, Oryctolagus cuniculus
QSVEESGGRLVTPGTPLTLTCTVSGIDLN

SEQ ID NO: 324 - protein, 5 aa, Oryctolagus cuniculus
SNGMS

SEQ ID NO: 325 - protein, 14 aa, Oryctolagus cuniculus
WVRQAPGEGLEWIG

SEQ ID NO: 326 - protein, 16 aa, Oryctolagus cuniculus
ASSIDGTTYYTNWAKG

SEQ ID NO: 327 - protein, 31 aa, Oryctolagus cuniculus
RFTISKTSSTTVDLKITSPTTEDTATYFCTR

SEQ ID NO: 328 - protein, 14 aa, Oryctolagus cuniculus
GEYAGVVGSNYFDL

SEQ ID NO: 329 - protein, 11 aa, Artificial
  Humanized antibody sequence
WGQGTLVTVSS

SEQ ID NO: 330 - protein, 330 aa, Artificial; identical to SEQ ID NO: 10
  Humanized antibody sequence

SEQ ID NO: 331 - DNA, 1350 bp, Artificial
  Humanized antibody sequence
cagtcggtggaggagtccgggggtcgcctggtcacgcctgggacacccctgacactcacctgcacagtgtctggaatcgacctcaatagcaatggaatgagctgggtccgccaggctccaggggaggggctggaatggatcggagccagtagtattgatgggaccacatactacaccaattgggcgaagggccgattcaccatctccaaaacctcgtcgaccacggtggatctgaaaatcaccagtccgacaaccgaggacacggccacctatttctgtaccagaggggagtatgctggtgttgttggttcgaactactttgacttgtggggccagggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 332 - DNA, 360 bp, Artificial
  Humanized antibody sequence
cagtcggtggaggagtccgggggtcgcctggtcacgcctgggacacccctgacactcacctgcacagtgtctggaatcgacctcaatagcaatggaatgagctgggtccgccaggctccaggggaggggctggaatggatcggagccagtagtattgatgggaccacatactacaccaattgggcgaagggccgattcaccatctccaaaacctcgtcgaccacggtggatctgaaaatcaccagtccgacaaccgaggacacggccacctatttctgtaccagaggggagtatgctggtgttgttggttcgaactactttgacttgtggggccagggcaccctcgtcaccgtctcgagc

SEQ ID NO: 333 - DNA, 87 bp, Oryctolagus cuniculus
cagtcggtggaggagtccgggggtcgcctggtcacgcctgggacacccctgacactcacctgcacagtgtctggaatcgacctcaat

SEQ ID NO: 334 - DNA, 15 bp, Oryctolagus cuniculus
agcaatggaatgagc

SEQ ID NO: 335 - DNA, 42 bp, Oryctolagus cuniculus
tgggtccgccaggctccaggggaggggctggaatggatcgga

SEQ ID NO: 336 - DNA, 48 bp, Oryctolagus cuniculus
gccagtagtattgatgggaccacatactacaccaattgggcgaagggc

SEQ ID NO: 337 - DNA, 93 bp, Oryctolagus cuniculus
cgattcaccatctccaaaacctcgtcgaccacggtggatctgaaaatcaccagtccgacaaccgaggacacggccacctatttctgtaccaga

SEQ ID NO: 338 - DNA, 42 bp, Oryctolagus cuniculus
ggggagtatgctggtgttgttggttcgaactactttgacttg

SEQ ID NO: 339 - DNA, 33 bp, Artificial
  Humanized antibody sequence
tggggccagggcaccctcgtcaccgtctcgagc

SEQ ID NO: 340 - DNA, 990 bp, Artificial; identical to SEQ ID NO: 20
  Humanized antibody sequence

SEQ ID NO: 341 - protein, 215 aa, Artificial
  Humanized antibody sequence
QVLTQTPPSVSAVVGGTVTINCQSSQRIYSNWLSWYQQKPGQTPKPLIYAASSLASGVPSRFKGSGSGTQFTLTISDLECDDAASYYCAGYYSGHIYSFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 109 aa, Artificial
  Humanized antibody sequence
QVLTQTPPSVSAVVGGTVTINCQSSQRIYSNWLSWYQQKPGQTPKPLIYAASSLASGVPSRFKGSGSGTQFTLTISDLECDDAASYYCAGYYSGHIYSFGGGTEVVVKR

SEQ ID NO: 343 - protein, 22 aa, Oryctolagus cuniculus
QVLTQTPPSVSAVVGGTVTINC

SEQ ID NO: 344 - protein, 12 aa, Oryctolagus cuniculus
QSSQRIYSNWLS

SEQ ID NO: 345 - protein, 15 aa, Oryctolagus cuniculus
WYQQKPGQTPKPLIY

SEQ ID NO: 346 - protein, 7 aa, Oryctolagus cuniculus
AASSLAS

SEQ ID NO: 347 - protein, 32 aa, Oryctolagus cuniculus
GVPSRFKGSGSGTQFTLTISDLECDDAASYYC

SEQ ID NO: 348 - protein, 10 aa, Oryctolagus cuniculus
AGYYSGHIYS

SEQ ID NO: 349 - protein, 11 aa, Artificial
  Humanized antibody sequence
FGGGTEVVVKR

SEQ ID NO: 350 - protein, 106 aa, Artificial; identical to SEQ ID NO: 30
  Humanized antibody sequence

SEQ ID NO: 351 - DNA, 645 bp, Artificial
  Humanized antibody sequence
caagtgctgacccagactccaccctccgtgtctgcagttgtgggaggcacagtcaccatcaattgccagtccagtcagaggatttatagtaattggttatcttggtatcagcagaaaccagggcagactcccaagcccctgatctatgctgcatccagcctggcatctggggtcccatcgcggttcaaaggcagtggatctgggacacagttcactctcaccatcagcgacctggagtgtgacgatgctgccagttactactgtgcaggctattatagtggtcatatttattctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 352 - DNA, 327 bp, Artificial
  Humanized antibody sequence
caagtgctgacccagactccaccctccgtgtctgcagttgtgggaggcacagtcaccatcaattgccagtccagtcagaggatttatagtaattggttatcttggtatcagcagaaaccagggcagactcccaagcccctgatctatgctgcatccagcctggcatctggggtcccatcgcggttcaaaggcagtggatctgggacacagttcactctcaccatcagcgacctggagtgtgacgatgctgccagttactactgtgcaggctattatagtggtcatatttattctttcggcggagggaccgaggtggtggtcaaacgt

SEQ ID NO: 353 - DNA, 66 bp, Oryctolagus cuniculus
caagtgctgacccagactccaccctccgtgtctgcagttgtgggaggcacagtcaccatcaattgc

SEQ ID NO: 354 - DNA, 36 bp, Oryctolagus cuniculus
cagtccagtcagaggatttatagtaattggttatct

SEQ ID NO: 355 - DNA, 45 bp, Oryctolagus cuniculus
tggtatcagcagaaaccagggcagactcccaagcccctgatctat

SEQ ID NO: 356 - DNA, 21 bp, Oryctolagus cuniculus
gctgcatccagcctggcatct

SEQ ID NO: 357 - DNA, 96 bp, Oryctolagus cuniculus
ggggtcccatcgcggttcaaaggcagtggatctgggacacagttcactctcaccatcagcgacctggagtgtgacgatgctgccagttactactgt

SEQ ID NO: 358 - DNA, 30 bp, Oryctolagus cuniculus
gcaggctattatagtggtcatatttattct

SEQ ID NO: 359 - DNA, 33 bp, Artificial; identical to SEQ ID NO: 39
  Humanized antibody sequence

SEQ ID NO: 360 - DNA, 318 bp, Artificial; identical to SEQ ID NO: 80
  Humanized antibody sequence

SEQ ID NO: 361 - protein, 452 aa, Artificial
  Humanized antibody sequence
EVQLVESGGGLVQPGGSLRLSCAASGFTVSSNGMSWVRQAPGKGLEWVGASSIDGTTYYTNSAKGRFTISRDNSKNTLYLQMNSLRAEDTAVYYCARGEYAGVVGSNYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 122 aa, Artificial
  Humanized antibody sequence
EVQLVESGGGLVQPGGSLRLSCAASGFTVSSNGMSWVRQAPGKGLEWVGASSIDGTTYYTNSAKGRFTISRDNSKNTLYLQMNSLRAEDTAVYYCARGEYAGVVGSNYFDLWGQGTLVTVSS

SEQ ID NO: 363 - protein, 30 aa, Artificial; identical to SEQ ID NO: 43
  Humanized antibody sequence

SEQ ID NO: 364 - protein, 5 aa, Oryctolagus cuniculus
SNGMS

SEQ ID NO: 365 - protein, 14 aa, Artificial
  Humanized antibody sequence
WVRQAPGKGLEWVG

SEQ ID NO: 366 - protein, 16 aa, Artificial
  Humanized antibody sequence
ASSIDGTTYYTNSAKG

SEQ ID NO: 367 - protein, 32 aa, Artificial; identical to SEQ ID NO: 47
  Humanized antibody sequence

SEQ ID NO: 368 - protein, 14 aa, Oryctolagus cuniculus
GEYAGVVGSNYFDL

SEQ ID NO: 369 - protein, 11 aa, Artificial
  Humanized antibody sequence
WGQGTLVTVSS

SEQ ID NO: 370 - protein, 330 aa, Artificial; identical to SEQ ID NO: 10
  Humanized antibody sequence

SEQ ID NO: 371 - DNA, 1356 bp, Artificial
  Humanized antibody sequence
gaggtgcagctggtggagtctgggggaggcttggtccagcctggggggtccctgagactctcctgtgcagcctctggattcaccgtcagtagcaatggaatgagctgggtccgtcaggctccagggaaggggctggagtgggtcggagccagtagtattgatgggaccacatactacaccaattctgcgaagggccgattcaccatctccagagacaattccaagaacaccctgtatcttcaaatgaacagcctgagagctgaggacactgctgtgtattactgtgctagaggggagtatgctggtgttgttggttcgaactactttgacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 372 - DNA, 366 bp, Artificial
  Humanized antibody sequence
gaggtgcagctggtggagtctgggggaggcttggtccagcctggggggtccctgagactctcctgtgcagcctctggattcaccgtcagtagcaatggaatgagctgggtccgtcaggctccagggaaggggctggagtgggtcggagccagtagtattgatgggaccacatactacaccaattctgcgaagggccgattcaccatctccagagacaattccaagaacaccctgtatcttcaaatgaacagcctgagagctgaggacactgctgtgtattactgtgctagaggggagtatgctggtgttgttggttcgaactactttgacttgtggggccaagggaccctcgtcaccgtctcgagc

SEQ ID NO: 373 - DNA, 90 bp, Artificial; identical to SEQ ID NO: 53
  Humanized antibody sequence

SEQ ID NO: 374 - DNA, 15 bp, Oryctolagus cuniculus
agcaatggaatgagc

SEQ ID NO: 375 - DNA, 42 bp, Artificial; identical to SEQ ID NO: 135
  Humanized antibody sequence

SEQ ID NO: 376 - DNA, 48 bp, Artificial
  Humanized antibody sequence
gccagtagtattgatgggaccacatactacaccaattctgcgaagggc

SEQ ID NO: 377 - DNA, 96 bp, Artificial; identical to SEQ ID NO: 57
  Humanized antibody sequence

SEQ ID NO: 378 - DNA, 42 bp, Oryctolagus cuniculus; identical to SEQ ID NO: 338

SEQ ID NO: 379 - DNA, 33 bp, Artificial; identical to SEQ ID NO: 59
  Humanized antibody sequence

SEQ ID NO: 380 - DNA, 990 bp, Artificial; identical to SEQ ID NO: 20
  Humanized antibody sequence

SEQ ID NO: 381 - protein, 216 aa, Artificial
  Humanized antibody sequence
DIQMTQSPSSVSASVGDRVTITCQSSQRIYSNWLSWYQQKPGKAPKLLIYAASSLASGVPSRFSGSGSGTDFTLTISSLQPEDFATYYCAGYYSGHIYSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 382 - protein, 110 aa, Artificial
  Humanized antibody sequence
DIQMTQSPSSVSASVGDRVTITCQSSQRIYSNWLSWYQQKPGKAPKLLIYAASSLASGVPSRFSGSGSGTDFTLTISSLQPEDFATYYCAGYYSGHIYSFGGGTKVEIKR

SEQ ID NO: 383 - protein, 23 aa, Artificial
  Humanized antibody sequence
DIQMTQSPSSVSASVGDRVTITC

SEQ ID NO: 384 - protein, 12 aa, Oryctolagus cuniculus
QSSQRIYSNWLS

SEQ ID NO: 385 - protein, 15 aa, Artificial
  Humanized antibody sequence
WYQQKPGKAPKLLIY

SEQ ID NO: 386 - protein, 7 aa, Oryctolagus cuniculus
AASSLAS

SEQ ID NO: 387 - protein, 32 aa, Artificial
  Humanized antibody sequence
GVPSRFSGSGSGTDFTLTISSLQPEDFATYYC

SEQ ID NO: 388 - protein, 10 aa, Oryctolagus cuniculus
AGYYSGHIYS

SEQ ID NO: 389 - protein, 11 aa, Artificial
  Humanized antibody sequence
FGGGTKVEIKR

SEQ ID NO: 390 - protein, 106 aa, Artificial; identical to SEQ ID NO: 30
  Humanized antibody sequence

SEQ ID NO: 391 - DNA, 648 bp, Artificial
  Humanized antibody sequence
gacatccagatgacccagtctccatcttccgtgtctgcatctgtaggagacagagtcaccatcacttgtcagtccagtcagaggatctatagtaattggttatcttggtatcagcagaaaccagggaaagcccctaagctcctgatctatgctgcatccagcctggcatctggggtcccatcaaggttcagcggcagtggatctgggacagatttcactctcaccatcagcagcctgcagcctgaagattttgcaacttactattgtgcaggctactatagtggtcatatctattctttcggcggaggaaccaaggtggaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 392 - DNA, 330 bp, Artificial
  Humanized antibody sequence
gacatccagatgacccagtctccatcttccgtgtctgcatctgtaggagacagagtcaccatcacttgtcagtccagtcagaggatctatagtaattggttatcttggtatcagcagaaaccagggaaagcccctaagctcctgatctatgctgcatccagcctggcatctggggtcccatcaaggttcagcggcagtggatctgggacagatttcactctcaccatcagcagcctgcagcctgaagattttgcaacttactattgtgcaggctactatagtggtcatatctattctttcggcggaggaaccaaggtggaaatcaaacgt

SEQ ID NO: 393 - DNA, 69 bp, Artificial
  Humanized antibody sequence
gacatccagatgacccagtctccatcttccgtgtctgcatctgtaggagacagagtcaccatcacttgt

SEQ ID NO: 394 - DNA, 36 bp, Oryctolagus cuniculus
cagtccagtcagaggatctatagtaattggttatct

SEQ ID NO: 395 - DNA, 45 bp, Artificial
  Humanized antibody sequence
tggtatcagcagaaaccagggaaagcccctaagctcctgatctat

SEQ ID NO: 396 - DNA, 21 bp, Oryctolagus cuniculus
gctgcatccagcctggcatct

SEQ ID NO: 397 - DNA, 96 bp, Artificial
  Humanized antibody sequence
ggggtcccatcaaggttcagcggcagtggatctgggacagatttcactctcaccatcagcagcctgcagcctgaagattttgcaacttactattgt

SEQ ID NO: 398 - DNA, 30 bp, Oryctolagus cuniculus
gcaggctactatagtggtcatatctattct

SEQ ID NO: 399 - DNA, 33 bp, Artificial; identical to SEQ ID NO: 79
  Humanized antibody sequence

SEQ ID NO: 400 - DNA, 318 bp, Artificial; identical to SEQ ID NO: 80
  Humanized antibody sequence

SEQ ID NO: 401 - protein, 458 aa, Artificial
  Humanized antibody sequence
QSMEESGGRLVTPGTPLTLTCTVSGFSLSDYALSWVRQAPGKGLEWIGMISSGDNTYYASWAKGRFTISKASTTVDLKITSPTTEDTATYFCARDKDASSGGYLVLDLLDVPDGMDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 128 aa, Artificial
  Humanized antibody sequence
QSMEESGGRLVTPGTPLTLTCTVSGFSLSDYALSWVRQAPGKGLEWIGMISSGDNTYYASWAKGRFTISKASTTVDLKITSPTTEDTATYFCARDKDASSGGYLVLDLLDVPDGMDLWGPGTLVTVSS

SEQ ID NO: 403 - protein, 29 aa, Oryctolagus cuniculus
QSMEESGGRLVTPGTPLTLTCTVSGFSLS

SEQ ID NO: 404 - protein, 5 aa, Oryctolagus cuniculus
DYALS

SEQ ID NO: 405 - protein, 14 aa, Oryctolagus cuniculus
WVRQAPGKGLEWIG

SEQ ID NO: 406 - protein, 16 aa, Oryctolagus cuniculus
MISSGDNTYYASWAKG

SEQ ID NO: 407 - protein, 30 aa, Oryctolagus cuniculus
RFTISKASTTVDLKITSPTTEDTATYFCAR

SEQ ID NO: 408 - protein, 23 aa, Oryctolagus cuniculus
DKDASSGGYLVLDLLDVPDGMDL

SEQ ID NO: 409 - protein, 11 aa, Artificial
  Humanized antibody sequence
WGPGTLVTVSS

SEQ ID NO: 410 - protein, 330 aa, Artificial; identical to SEQ ID NO: 10
  Humanized antibody sequence

SEQ ID NO: 411 - DNA, 1374 bp, Artificial
  Humanized antibody sequence
cagtcaatggaggagtccgggggtcgcctggtcacgcctgggacacccctgacactcacctgcacagtctctggattctccctcagtgactatgcgttgagctgggtccgccaggctccagggaaggggctggaatggatcggaatgattagtagtggtgacaacacatactacgcgagctgggcgaaaggccgattcaccatctccaaagcctcgaccacggtggatctgaaaatcaccagtccgacaaccgaggacacggccacctatttctgtgccagagataaagatgctagtagtggtggttatttggtccttgacctattggatgtccccgacggcatggacctctggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 412 - DNA, 384 bp, Artificial
  Humanized antibody sequence
cagtcaatggaggagtccgggggtcgcctggtcacgcctgggacacccctgacactcacctgcacagtctctggattctccctcagtgactatgcgttgagctgggtccgccaggctccagggaaggggctggaatggatcggaatgattagtagtggtgacaacacatactacgcgagctgggcgaaaggccgattcaccatctccaaagcctcgaccacggtggatctgaaaatcaccagtccgacaaccgaggacacggccacctatttctgtgccagagataaagatgctagtagtggtggttatttggtccttgacctattggatgtccccgacggcatggacctctggggcccaggcaccctcgtcaccgtctcgagc

SEQ ID NO: 413 - DNA, 87 bp, Oryctolagus cuniculus
cagtcaatggaggagtccgggggtcgcctggtcacgcctgggacacccctgacactcacctgcacagtctctggattctccctcagt

SEQ ID NO: 414 - DNA, 15 bp, Oryctolagus cuniculus
gactatgcgttgagc

SEQ ID NO: 415 - DNA, 42 bp, Oryctolagus cuniculus; identical to SEQ ID NO: 95

SEQ ID NO: 416 - DNA, 48 bp, Oryctolagus cuniculus
atgattagtagtggtgacaacacatactacgcgagctgggcgaaaggc

SEQ ID NO: 417 - DNA, 90 bp, Oryctolagus cuniculus
cgattcaccatctccaaagcctcgaccacggtggatctgaaaatcaccagtccgacaaccgaggacacggccacctatttctgtgccaga

SEQ ID NO: 418 - DNA, 69 bp, Oryctolagus cuniculus
gataaagatgctagtagtggtggttatttggtccttgacctattggatgtccccgacggcatggacctc

SEQ ID NO: 419 - DNA, 33 bp, Artificial; identical to SEQ ID NO: 179
  Humanized antibody sequence

SEQ ID NO: 420 - DNA, 990 bp, Artificial; identical to SEQ ID NO: 20
  Humanized antibody sequence

SEQ ID NO: 421 - protein, 219 aa, Artificial
  Humanized antibody sequence
AVLTQTPSPVSAAVGGTVTIKCQSSQSVYNNNLLSWYQQKPGQPPKLLIWGASYLPSGVPDRFSGSGSGTQFTLTISGVQCDDAATYYCLGGYDGDADTYNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 422 - protein, 113 aa, Artificial
  Humanized antibody sequence
AVLTQTPSPVSAAVGGTVTIKCQSSQSVYNNNLLSWYQQKPGQPPKLLIWGASYLPSGVPDRFSGSGSGTQFTLTISGVQCDDAATYYCLGGYDGDADTYNTFGGGTEVVVKR

SEQ ID NO: 423 - protein, 22 aa, Oryctolagus cuniculus
AVLTQTPSPVSAAVGGTVTIKC

SEQ ID NO: 424 - protein, 13 aa, Oryctolagus cuniculus
QSSQSVYNNNLLS

SEQ ID NO: 425 - protein, 15 aa, Oryctolagus cuniculus
WYQQKPGQPPKLLIW

SEQ ID NO: 426 - protein, 7 aa, Oryctolagus cuniculus
GASYLPS

SEQ ID NO: 427 - protein, 32 aa, Oryctolagus cuniculus
GVPDRFSGSGSGTQFTLTISGVQCDDAATYYC

SEQ ID NO: 428 - protein, 13 aa, Oryctolagus cuniculus
LGGYDGDADTYNT

SEQ ID NO: 429 - protein, 11 aa, Artificial
  Humanized antibody sequence
FGGGTEVVVKR

SEQ ID NO: 430 - protein, 106 aa, Artificial; identical to SEQ ID NO: 30
  Humanized antibody sequence

SEQ ID NO: 431 - DNA, 657 bp, Artificial
  Humanized antibody sequence
gccgtgctgacccagacaccatcgcccgtgtctgcagctgtgggaggcacagtcaccatcaagtgccagtccagtcagagtgtttataataacaacctcttatcctggtatcagcagaaaccagggcagcctcccaagctcctgatctggggtgcatcctatctgccatctggggtcccagataggttcagcggcagtggatctgggacacagttcactctcaccatcagcggcgtgcagtgtgacgatgctgccacttactactgtctaggcggttatgatggtgatgctgatacatataatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 432 - DNA, 339 bp, Artificial
  Humanized antibody sequence
gccgtgctgacccagacaccatcgcccgtgtctgcagctgtgggaggcacagtcaccatcaagtgccagtccagtcagagtgtttataataacaacctcttatcctggtatcagcagaaaccagggcagcctcccaagctcctgatctggggtgcatcctatctgccatctggggtcccagataggttcagcggcagtggatctgggacacagttcactctcaccatcagcggcgtgcagtgtgacgatgctgccacttactactgtctaggcggttatgatggtgatgctgatacatataatactttcggcggagggaccgaggtggtggtcaaacgt

SEQ ID NO: 433 - DNA, 66 bp, Oryctolagus cuniculus
gccgtgctgacccagacaccatcgcccgtgtctgcagctgtgggaggcacagtcaccatcaagtgc

SEQ ID NO: 434 - DNA, 39 bp, Oryctolagus cuniculus
cagtccagtcagagtgtttataataacaacctcttatcc

SEQ ID NO: 435 - DNA, 45 bp, Oryctolagus cuniculus
tggtatcagcagaaaccagggcagcctcccaagctcctgatctgg

SEQ ID NO: 436 - DNA, 21 bp, Oryctolagus cuniculus
ggtgcatcctatctgccatct

SEQ ID NO: 437 - DNA, 96 bp, Oryctolagus cuniculus
ggggtcccagataggttcagcggcagtggatctgggacacagttcactctcaccatcagcggcgtgcagtgtgacgatgctgccacttactactgt

SEQ ID NO: 438 - DNA, 39 bp, Oryctolagus cuniculus
ctaggcggttatgatggtgatgctgatacatataatact

SEQ ID NO: 439 - DNA, 33 bp, Artificial; identical to SEQ ID NO: 39
  Humanized antibody sequence

SEQ ID NO: 440 - DNA, 318 bp, Artificial; identical to SEQ ID NO: 80
  Humanized antibody sequence

SEQ ID NO: 441 - protein, 446 aa, Artificial
  Humanized antibody sequence
QSLEESGGRLVTPGGSLTLTCTVSGIDLSSNAISWVRQAPEKGLEWIAVIYVVGATDYASWAKGRFTISRTSTTVDLKMTSLTTEDTATYFCARVYDSGWNHFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - protein, 116 aa, Artificial
  Humanized antibody sequence
QSLEESGGRLVTPGGSLTLTCTVSGIDLSSNAISWVRQAPEKGLEWIAVIYVVGATDYASWAKGRFTISRTSTTVDLKMTSLTTEDTATYFCARVYDSGWNHFNLWGPGTLVTVSS

SEQ ID NO: 443 - protein, 29 aa, Oryctolagus cuniculus
QSLEESGGRLVTPGGSLTLTCTVSGIDLS

SEQ ID NO: 444 - protein, 5 aa, Oryctolagus cuniculus
SNAIS

SEQ ID NO: 445 - protein, 14 aa, Oryctolagus cuniculus
WVRQAPEKGLEWIA

SEQ ID NO: 446 - protein, 16 aa, Oryctolagus cuniculus
VIYVVGATDYASWAKG

SEQ ID NO: 447 - protein, 30 aa, Oryctolagus cuniculus
RFTISRTSTTVDLKMTSLTTEDTATYFCAR

SEQ ID NO: 448 - protein, 11 aa, Oryctolagus cuniculus
VYDSGWNHFNL

SEQ ID NO: 449 - protein, 11 aa, Artificial
  Humanized antibody sequence
WGPGTLVTVSS

SEQ ID NO: 450 - protein, 330 aa, Artificial; identical to SEQ ID NO: 10
  Humanized antibody sequence

SEQ ID NO: 451 - DNA, 1338 bp, Artificial
  Humanized antibody sequence
cagtcgctggaggagtccgggggtcgcctggtaacgcctggaggatccctgacactcacctgcacagtctctggaatcgacctcagtagcaatgcaataagctgggtccgccaggctccagagaaggggctggagtggatcgcagtcatttatgttgttggtgccactgactacgcgagctgggcgaaaggccgattcaccatctccagaacctcgaccacggtggatctgaaaatgaccagtctgacaaccgaggacacggccacctatttctgtgccagagtttatgattctggctggaatcactttaacttgtggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 452 - DNA, 348 bp, Artificial
  Humanized antibody sequence
cagtcgctggaggagtccgggggtcgcctggtaacgcctggaggatccctgacactcacctgcacagtctctggaatcgacctcagtagcaatgcaataagctgggtccgccaggctccagagaaggggctggagtggatcgcagtcatttatgttgttggtgccactgactacgcgagctgggcgaaaggccgattcaccatctccagaacctcgaccacggtggatctgaaaatgaccagtctgacaaccgaggacacggccacctatttctgtgccagagtttatgattctggctggaatcactttaacttgtggggcccaggcaccctcgtcaccgtctcgagc

SEQ ID NO: 453 - DNA, 87 bp, Oryctolagus cuniculus
cagtcgctggaggagtccgggggtcgcctggtaacgcctggaggatccctgacactcacctgcacagtctctggaatcgacctcagt

SEQ ID NO: 454 - DNA, 15 bp, Oryctolagus cuniculus
agcaatgcaataagc

SEQ ID NO: 455 - DNA, 42 bp, Oryctolagus cuniculus; identical to SEQ ID NO: 15

SEQ ID NO: 456 - DNA, 48 bp, Oryctolagus cuniculus
gtcatttatgttgttggtgccactgactacgcgagctgggcgaaaggc

SEQ ID NO: 457 - DNA, 90 bp, Oryctolagus cuniculus
cgattcaccatctccagaacctcgaccacggtggatctgaaaatgaccagtctgacaaccgaggacacggccacctatttctgtgccaga

SEQ ID NO: 458 - DNA, 33 bp, Oryctolagus cuniculus; identical to SEQ ID NO: 218

SEQ ID NO: 459 - DNA, 33 bp, Artificial; identical to SEQ ID NO: 179
  Humanized antibody sequence

SEQ ID NO: 460 - DNA, 990 bp, Artificial; identical to SEQ ID NO: 20
  Humanized antibody sequence

SEQ ID NO: 461 - protein, 217 aa, Artificial
  Humanized antibody sequence
AYDMTQTPASVEVAVGGTVTIKCQVSQSISSWLSWYQKKPGQRPKLLIYRASTLASGVSSRFKGSGSGTEFTLTISGVECADAATYYCQQAYSVSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - protein, 111 aa, Artificial
  Humanized antibody sequence
AYDMTQTPASVEVAVGGTVTIKCQVSQSISSWLSWYQKKPGQRPKLLIYRASTLASGVSSRFKGSGSGTEFTLTISGVECADAATYYCQQAYSVSNVDNAFGGGTEVVVKR

SEQ ID NO: 463 - protein, 23 aa, Oryctolagus cuniculus
AYDMTQTPASVEVAVGGTVTIKC

SEQ ID NO: 464 - protein, 11 aa, Oryctolagus cuniculus
QVSQSISSWLS

SEQ ID NO: 465 - protein, 15 aa, Oryctolagus cuniculus
WYQKKPGQRPKLLIY

SEQ ID NO: 466 - protein, 7 aa, Oryctolagus cuniculus
RASTLAS

SEQ ID NO: 467 - protein, 32 aa, Oryctolagus cuniculus
GVSSRFKGSGSGTEFTLTISGVECADAATYYC

SEQ ID NO: 468 - protein, 12 aa, Oryctolagus cuniculus
QQAYSVSNVDNA

SEQ ID NO: 469 - protein, 11 aa, Artificial
  Humanized antibody sequence
FGGGTEVVVKR

SEQ ID NO: 470 - protein, 106 aa, Artificial; identical to SEQ ID NO: 30
  Humanized antibody sequence

SEQ ID NO: 471 - DNA, 651 bp, Artificial
  Humanized antibody sequence
gcctatgatatgacccagactccagcctctgtggaggtagctgtgggaggcacagtcaccatcaagtgccaggtcagtcagagcattagtagttggttatcctggtatcagaagaaaccagggcagcgtcccaagctcctgatctacagggcatccactctggcatctggggtctcatcgcggttcaaaggcagtggatctgggacagagttcactctcaccatcagcggcgtggagtgtgccgatgctgccacttactactgtcaacaggcttatagtgttagtaatgttgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 472 - DNA, 333 bp, Artificial
  Humanized antibody sequence
gcctatgatatgacccagactccagcctctgtggaggtagctgtgggaggcacagtcaccatcaagtgccaggtcagtcagagcattagtagttggttatcctggtatcagaagaaaccagggcagcgtcccaagctcctgatctacagggcatccactctggcatctggggtctcatcgcggttcaaaggcagtggatctgggacagagttcactctcaccatcagcggcgtggagtgtgccgatgctgccacttactactgtcaacaggcttatagtgttagtaatgttgataatgctttcggcggagggaccgaggtggtggtcaaacgt

SEQ ID NO: 473 - DNA, 69 bp, Oryctolagus cuniculus; identical to SEQ ID NO: 273

SEQ ID NO: 474 - DNA, 33 bp, Oryctolagus cuniculus
caggtcagtcagagcattagtagttggttatcc

SEQ ID NO: 475 - DNA, 45 bp, Oryctolagus cuniculus
tggtatcagaagaaaccagggcagcgtcccaagctcctgatctac

SEQ ID NO: 476 - DNA, 21 bp, Oryctolagus cuniculus
agggcatccactctggcatct

SEQ ID NO: 477 - DNA, 96 bp, Oryctolagus cuniculus
ggggtctcatcgcggttcaaaggcagtggatctgggacagagttcactctcaccatcagcggcgtggagtgtgccgatgctgccacttactactgt

SEQ ID NO: 478 - DNA, 36 bp, Oryctolagus cuniculus; identical to SEQ ID NO: 38

SEQ ID NO: 479 - DNA, 33 bp, Artificial; identical to SEQ ID NO: 39
  Humanized antibody sequence

SEQ ID NO: 480 - DNA, 318 bp, Artificial; identical to SEQ ID NO: 80
  Humanized antibody sequence

SEQ ID NO: 481 - protein, 449 aa, Artificial
  Humanized antibody sequence
EVQLVESGGGLVQPGGSLRLSCAASGFTVSSNAISWVRQAPGKGLEWVAVIYVVGATDYASSAKGRFTISRDNSKNTLYLQMNSLRAEDTAVYYCARVYDSGWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 482 - protein, 119 aa, Artificial
  Humanized antibody sequence
EVQLVESGGGLVQPGGSLRLSCAASGFTVSSNAISWVRQAPGKGLEWVAVIYVVGATDYASSAKGRFTISRDNSKNTLYLQMNSLRAEDTAVYYCARVYDSGWNHFNLWGQGTLVTVSS

SEQ ID NO: 483 - protein, 30 aa, Artificial; identical to SEQ ID NO: 43
  Humanized antibody sequence

SEQ ID NO: 484 - protein, 5 aa, Oryctolagus cuniculus
SNAIS

SEQ ID NO: 485 - protein, 14 aa, Artificial
  Humanized antibody sequence
WVRQAPGKGLEWVA

SEQ ID NO: 486 - protein, 16 aa, Artificial
  Humanized antibody sequence
VIYVVGATDYASSAKG

SEQ ID NO: 487 - protein, 32 aa, Artificial; identical to SEQ ID NO: 47
  Humanized antibody sequence

SEQ ID NO: 488 - protein, 11 aa, Oryctolagus cuniculus
VYDSGWNHFNL

SEQ ID NO: 489 - protein, 11 aa, Artificial
  Humanized antibody sequence
WGQGTLVTVSS

SEQ ID NO: 490 - protein, 330 aa, Artificial; identical to SEQ ID NO: 10
  Humanized antibody sequence

SEQ ID NO: 491 - DNA, 1347 bp, Artificial
  Humanized antibody sequence
gaggtgcagctggtggagtctgggggaggcttggtccagcctggggggtccctgagactctcctgtgcagcctctggattcaccgtcagtagcaatgcaataagctgggtccgtcaggctccagggaaggggctggagtgggtcgcagtcatctatgttgttggtgccactgactacgcgagcagtgcgaaaggccgattcaccatctccagagacaattccaagaacaccctgtatcttcaaatgaacagcctgagagctgaggacactgctgtgtattactgtgctagagtttatgattctggctggaatcactttaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 492 - DNA, 357 bp, Artificial
  Humanized antibody sequence
gaggtgcagctggtggagtctgggggaggcttggtccagcctggggggtccctgagactctcctgtgcagcctctggattcaccgtcagtagcaatgcaataagctgggtccgtcaggctccagggaaggggctggagtgggtcgcagtcatctatgttgttggtgccactgactacgcgagcagtgcgaaaggccgattcaccatctccagagacaattccaagaacaccctgtatcttcaaatgaacagcctgagagctgaggacactgctgtgtattactgtgctagagtttatgattctggctggaatcactttaacttgtggggccaagggaccctcgtcaccgtctcgagc

SEQ ID NO: 493 - DNA, 90 bp, Artificial; identical to SEQ ID NO: 53
  Humanized antibody sequence

SEQ ID NO: 494 - DNA, 15 bp, Oryctolagus cuniculus
agcaatgcaataagc

SEQ ID NO: 495 - DNA, 42 bp, Artificial; identical to SEQ ID NO: 55
  Humanized antibody sequence

SEQ ID NO: 496 - DNA, 48 bp, Artificial
  Humanized antibody sequence
gtcatctatgttgttggtgccactgactacgcgagcagtgcgaaaggc

SEQ ID NO: 497 - DNA, 96 bp, Artificial; identical to SEQ ID NO: 57
  Humanized antibody sequence

SEQ ID NO: 498 - DNA, 33 bp, Oryctolagus cuniculus; identical to SEQ ID NO: 218

SEQ ID NO: 499 - DNA, 33 bp, Artificial; identical to SEQ ID NO: 59
  Humanized antibody sequence

SEQ ID NO: 500 - DNA, 990 bp, Artificial; identical to SEQ ID NO: 20
  Humanized antibody sequence

SEQ ID NO: 501 - protein, 217 aa, Artificial
  Humanized antibody sequence
DYQMTQSPSTLSASVGDRVTITCQVSQSISSWLSWYQQKPGKAPKLLIYRASTLASGVPSRFSGSGSGTEFTLTISSLQPDDFATYYCQQAYSVSNVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 111 aa, Artificial
  Humanized antibody sequence
DYQMTQSPSTLSASVGDRVTITCQVSQSISSWLSWYQQKPGKAPKLLIYRASTLASGVPSRFSGSGSGTEFTLTISSLQPDDFATYYCQQAYSVSNVDNAFGGGTKVEIKR

SEQ ID NO: 503 - protein, 23 aa, Artificial
  Humanized antibody sequence
DYQMTQSPSTLSASVGDRVTITC

SEQ ID NO: 504 - protein, 11 aa, Oryctolagus cuniculus
QVSQSISSWLS

SEQ ID NO: 505 - protein, 15 aa, Artificial
  Humanized antibody sequence
WYQQKPGKAPKLLIY

SEQ ID NO: 506 - protein, 7 aa, Oryctolagus cuniculus
RASTLAS

SEQ ID NO: 507 - protein, 32 aa, Artificial; identical to SEQ ID NO: 67
  Humanized antibody sequence

SEQ ID NO: 508 - protein, 12 aa, Oryctolagus cuniculus
QQAYSVSNVDNA

SEQ ID NO: 509 - protein, 11 aa, Artificial
  Humanized antibody sequence
FGGGTKVEIKR

SEQ ID NO: 510 - protein, 106 aa, Artificial; identical to SEQ ID NO: 30
  Humanized antibody sequence

SEQ ID NO: 511 - DNA, 651 bp, Artificial
  Humanized antibody sequence
gactatcagatgacccagtctccttccaccctgtctgcatctgtaggagacagagtcaccatcacttgccaggtcagtcagagcattagtagttggttatcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttattactgccaacaggcttatagtgttagtaatgttgataatgctttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 512 - DNA, 333 bp, Artificial
  Humanized antibody sequence
gactatcagatgacccagtctccttccaccctgtctgcatctgtaggagacagagtcaccatcacttgccaggtcagtcagagcattagtagttggttatcctggtatcagcagaaaccaggaaaagcccctaagctcctgatctatagggcatccactctggcatctggagtcccatcaaggttcagcggcagtggatctggaacagaattcactctcaccatcagcagcctgcagcctgatgattttgcaacttattactgccaacaggcttatagtgttagtaatgttgataatgctttcggcggaggaaccaaggtggaaatcaaacgt

SEQ ID NO: 513 - DNA, 69 bp, Artificial
  Humanized antibody sequence
gactatcagatgacccagtctccttccaccctgtctgcatctgtaggagacagagtcaccatcacttgc

SEQ ID NO: 514 - DNA, 33 bp, Oryctolagus cuniculus; identical to SEQ ID NO: 474

SEQ ID NO: 515 - DNA, 45 bp, Artificial; identical to SEQ ID NO: 75
  Humanized antibody sequence

SEQ ID NO: 516 - DNA, 21 bp, Oryctolagus cuniculus
agggcatccactctggcatct

SEQ ID NO: 517 - DNA, 96 bp, Artificial; identical to SEQ ID NO: 77
  Humanized antibody sequence

SEQ ID NO: 518 - DNA, 36 bp, Oryctolagus cuniculus; identical to SEQ ID NO: 38

SEQ ID NO: 519 - DNA, 33 bp, Artificial; identical to SEQ ID NO: 79
  Humanized antibody sequence

SEQ ID NO: 520 - DNA, 318 bp, Artificial; identical to SEQ ID NO: 40
  Humanized antibody sequence

SEQ ID NO: 521 - protein, 446 aa, Artificial
  Humanized antibody sequence
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 116 aa, Artificial
  Humanized antibody sequence
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGQGTLVTVSS

SEQ ID NO: 523 - protein, 29 aa, Oryctolagus cuniculus
QSVEESGGRLVTPGTPLTLTCTVSGFSLS

SEQ ID NO: 524 - protein, 5 aa, Oryctolagus cuniculus
NYAMT

SEQ ID NO: 525 - protein, 14 aa, Oryctolagus cuniculus
WVRQAPGKGLEWIG

SEQ ID NO: 526 - protein, 16 aa, Oryctolagus cuniculus
VISFGGNTYYANWAKG

SEQ ID NO: 527 - protein, 30 aa, Oryctolagus cuniculus; identical to SEQ ID NO: 167

SEQ ID NO: 528 - protein, 11 aa, Oryctolagus cuniculus
WDAENNEILNL

SEQ ID NO: 529 - protein, 11 aa, Artificial
  Humanized antibody sequence
WGQGTLVTVSS

SEQ ID NO: 530 - protein, 330 aa, Artificial; identical to SEQ ID NO: 10
  Humanized antibody sequence

SEQ ID NO: 531 - DNA, 1338 bp, Artificial
  Humanized antibody sequence
cagtcggtggaggagtccgggggtcgcctggtcacgcctgggacacccctgacactcacctgcacagtctctggattctccctcagtaactacgcaatgacctgggtccgccaggctccagggaaggggctggaatggatcggagtcattagttttggtggtaacacatactacgcgaactgggcgaaaggccgattcaccatctccaaaacctcgaccacggtggatctgaaaatcaccagtccgacaaccgaggacacggccacctatttctgtgccagatgggatgctgaaaacaatgagattcttaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - DNA, 348 bp, Artificial
  Humanized antibody sequence
cagtcggtggaggagtccgggggtcgcctggtcacgcctgggacacccctgacactcacctgcacagtctctggattctccctcagtaactacgcaatgacctgggtccgccaggctccagggaaggggctggaatggatcggagtcattagttttggtggtaacacatactacgcgaactgggcgaaaggccgattcaccatctccaaaacctcgaccacggtggatctgaaaatcaccagtccgacaaccgaggacacggccacctatttctgtgccagatgggatgctgaaaacaatgagattcttaacttgtggggccaagggaccctcgtcaccgtctcgagc

SEQ ID NO: 533 - DNA, 87 bp, Oryctolagus cuniculus; identical to SEQ ID NO: 13

SEQ ID NO: 534 - DNA, 15 bp, Oryctolagus cuniculus
aactacgcaatgacc

SEQ ID NO: 535 - DNA, 42 bp, Oryctolagus cuniculus; identical to SEQ ID NO: 95

SEQ ID NO: 536 - DNA, 48 bp, Oryctolagus cuniculus
gtcattagttttggtggtaacacatactacgcgaactgggcgaaaggc

SEQ ID NO: 537 - DNA, 90 bp, Oryctolagus cuniculus
cgattcaccatctccaaaacctcgaccacggtggatctgaaaatcaccagtccgacaaccgaggacacggccacctatttctgtgccaga

SEQ ID NO: 538 - DNA, 33 bp, Oryctolagus cuniculus
tgggatgctgaaaacaatgagattcttaacttg

SEQ ID NO: 539 - DNA, 33 bp, Artificial; identical to SEQ ID NO: 59
  Humanized antibody sequence

SEQ ID NO: 540 - DNA, 990 bp, Artificial; identical to SEQ ID NO: 20
  Humanized antibody sequence

SEQ ID NO: 541 - protein, 217 aa, Artificial
  Humanized antibody sequence
AYDMTQTPASVEVAVGGTVTIKCQASESIESYLAWYQQKSGQPPKLLIYRASTLASGVSSRFKGSGSGTQFTLTISGVECADAATYYCQQGDAWSNVDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 111 aa, Artificial
  Humanized antibody sequence
AYDMTQTPASVEVAVGGTVTIKCQASESIESYLAWYQQKSGQPPKLLIYRASTLASGVSSRFKGSGSGTQFTLTISGVECADAATYYCQQGDAWSNVDNVFGGGTEVVVKR

SEQ ID NO: 543 - protein, 23 aa, Oryctolagus cuniculus
AYDMTQTPASVEVAVGGTVTIKC

SEQ ID NO: 544 - protein, 11 aa, Oryctolagus cuniculus
QASESIESYLA

SEQ ID NO: 545 - protein, 15 aa, Oryctolagus cuniculus
WYQQKSGQPPKLLIY

SEQ ID NO: 546 - protein, 7 aa, Oryctolagus cuniculus
RASTLAS

SEQ ID NO: 547 - protein, 32 aa, Oryctolagus cuniculus
GVSSRFKGSGSGTQFTLTISGVECADAATYYC

SEQ ID NO: 548 - protein, 12 aa, Oryctolagus cuniculus
QQGDAWSNVDNV

SEQ ID NO: 549 - protein, 11 aa, Artificial
  Humanized antibody sequence
FGGGTEVVVKR

SEQ ID NO: 550 - protein, 106 aa, Artificial; identical to SEQ ID NO: 30
  Humanized antibody sequence

SEQ ID NO: 551 - DNA, 651 bp, Artificial
  Humanized antibody sequence
gcctatgatatgacccagactccagcctctgtggaggtagctgtgggaggcacagtcaccatcaagtgccaggccagtgagagcattgaaagctatttagcctggtatcagcagaaatcagggcagcctcccaagctcctgatctacagggcttccactctggcatctggggtctcatcgcggttcaaaggcagtggatctgggacacagttcactctcaccatcagcggcgtggaatgtgccgatgctgccacttactactgtcaacagggtgatgcttggagtaatgttgataatgttttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 552 - DNA, 333 bp, Artificial
  Humanized antibody sequence
gcctatgatatgacccagactccagcctctgtggaggtagctgtgggaggcacagtcaccatcaagtgccaggccagtgagagcattgaaagctatttagcctggtatcagcagaaatcagggcagcctcccaagctcctgatctacagggcttccactctggcatctggggtctcatcgcggttcaaaggcagtggatctgggacacagttcactctcaccatcagcggcgtggaatgtgccgatgctgccacttactactgtcaacagggtgatgcttggagtaatgttgataatgttttcggcggagggaccgaggtggtggtcaaacgt

SEQ ID NO: 553 - DNA, 69 bp, Oryctolagus cuniculus; identical to SEQ ID NO: 273

SEQ ID NO: 554 - DNA, 33 bp, Oryctolagus cuniculus
caggccagtgagagcattgaaagctatttagcc

SEQ ID NO: 555 - DNA, 45 bp, Oryctolagus cuniculus
tggtatcagcagaaatcagggcagcctcccaagctcctgatctac

SEQ ID NO: 556 - DNA, 21 bp, Oryctolagus cuniculus
agggcttccactctggcatct

SEQ ID NO: 557 - DNA, 96 bp, Oryctolagus cuniculus
ggggtctcatcgcggttcaaaggcagtggatctgggacacagttcactctcaccatcagcggcgtggaatgtgccgatgctgccacttactactgt

SEQ ID NO: 558 - DNA, 36 bp, Oryctolagus cuniculus
caacagggtgatgcttggagtaatgttgataatgtt

SEQ ID NO: 559 - DNA, 33 bp, Artificial; identical to SEQ ID NO: 39
  Humanized antibody sequence

SEQ ID NO: 560 - DNA, 318 bp, Artificial; identical to SEQ ID NO: 80
  Humanized antibody sequence

SEQ ID NO: 561 - protein, 446 aa, Artificial
  Humanized antibody sequence
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 116 aa, Artificial
  Humanized antibody sequence
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGPGTLVTVSS

SEQ ID NO: 563 - protein, 29 aa, Oryctolagus cuniculus
QSVEESGGRLVTPGTPLTLTCTVSGFSLS

SEQ ID NO: 564 - protein, 5 aa, Oryctolagus cuniculus
NYAMT

SEQ ID NO: 565 - protein, 14 aa, Oryctolagus cuniculus
WVRQAPGKGLEWIG

SEQ ID NO: 566 - protein, 16 aa, Oryctolagus cuniculus
VISFGGNTYYANWAKG

SEQ ID NO: 567 - protein, 30 aa, Oryctolagus cuniculus; identical to SEQ ID NO: 167

SEQ ID NO: 568 - protein, 11 aa, Oryctolagus cuniculus
WDAENNEILNL

SEQ ID NO: 569 - protein, 11 aa, Artificial
  Humanized antibody sequence
WGPGTLVTVSS

SEQ ID NO: 570 - protein, 330 aa, Artificial; identical to SEQ ID NO: 10
  Humanized antibody sequence

SEQ ID NO: 571 - DNA, 1338 bp, Artificial
  Humanized antibody sequence
cagtcggtggaggagtccgggggtcgcctggtcacgcctgggacacccctgacactcacctgcacagtctctggattctccctcagtaactacgcaatgacctgggtccgccaggctccagggaaggggctggaatggatcggagtcattagttttggtggtaacacatactacgcgaactgggcgaaaggccgattcaccatctccaaaacctcgaccacggtggatctgaaaatcaccagtccgacaaccgaggacacggccacctatttctgtgccagatgggatgctgaaaacaatgagattcttaacttgtggggcccagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 572 - DNA, 348 bp, Artificial
  Humanized antibody sequence
cagtcggtggaggagtccgggggtcgcctggtcacgcctgggacacccctgacactcacctgcacagtctctggattctccctcagtaactacgcaatgacctgggtccgccaggctccagggaaggggctggaatggatcggagtcattagttttggtggtaacacatactacgcgaactgggcgaaaggccgattcaccatctccaaaacctcgaccacggtggatctgaaaatcaccagtccgacaaccgaggacacggccacctatttctgtgccagatgggatgctgaaaacaatgagattcttaacttgtggggcccagggaccctcgtcaccgtctcgagc

SEQ ID NO: 573 - DNA, 87 bp, Oryctolagus cuniculus; identical to SEQ ID NO: 13

SEQ ID NO: 574 - DNA, 15 bp, Oryctolagus cuniculus
aactacgcaatgacc

SEQ ID NO: 575 - DNA, 42 bp, Oryctolagus cuniculus; identical to SEQ ID NO: 95

SEQ ID NO: 576 - DNA, 48 bp, Oryctolagus cuniculus; identical to SEQ ID NO: 536

SEQ ID NO: 577 - DNA, 90 bp, Oryctolagus cuniculus; identical to SEQ ID NO: 537

SEQ ID NO: 578 - DNA, 33 bp, Oryctolagus cuniculus; identical to SEQ ID NO: 538

SEQ ID NO: 579 - DNA, 33 bp, Artificial; identical to SEQ ID NO: 259
  Humanized antibody sequence

SEQ ID NO: 580 - DNA, 990 bp, Artificial; identical to SEQ ID NO: 20
  Humanized antibody sequence

SEQ ID NO: 581 - protein, 217 aa, Artificial
  Humanized antibody sequence
AYDMTQTPASVEVAVGGTVTIKCQASESISSYLAWYQQKSGQPPKLLIYRASTLASGVSSRFKGSGSGTQFTLTISGVECADAATYYCQQGDAWSNVDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 582 - protein, 111 aa, Artificial
  Humanized antibody sequence
AYDMTQTPASVEVAVGGTVTIKCQASESISSYLAWYQQKSGQPPKLLIYRASTLASGVSSRFKGSGSGTQFTLTISGVECADAATYYCQQGDAWSNVDNVFGGGTEVVVKR

SEQ ID NO: 583 - protein, 23 aa, Oryctolagus cuniculus
AYDMTQTPASVEVAVGGTVTIKC

SEQ ID NO: 584 - protein, 11 aa, Oryctolagus cuniculus
QASESISSYLA

SEQ ID NO: 585 - protein, 15 aa, Oryctolagus cuniculus
WYQQKSGQPPKLLIY

SEQ ID NO: 586 - protein, 7 aa, Oryctolagus cuniculus
RASTLAS

SEQ ID NO: 587 - protein, 32 aa, Oryctolagus cuniculus; identical to SEQ ID NO: 547

SEQ ID NO: 588 - protein, 12 aa, Oryctolagus cuniculus
QQGDAWSNVDNV

SEQ ID NO: 589 - protein, 11 aa, Artificial
  Humanized antibody sequence
FGGGTEVVVKR

SEQ ID NO: 590 - protein, 106 aa, Artificial; identical to SEQ ID NO: 30
  Humanized antibody sequence

SEQ ID NO: 591 - DNA, 651 bp, Artificial
  Humanized antibody sequence
gcctatgatatgacccagactccagcctctgtggaggtagctgtgggaggcacagtcaccatcaagtgccaggccagtgagagcattagtagctacttagcctggtatcagcagaaatcagggcagcctcccaagctcctgatctacagggcttccactctggcatctggggtctcatcgcggttcaaaggcagtggatctgggacacagttcactctcaccatcagcggcgtggagtgtgccgatgctgccacttactactgtcaacagggtgatgcttggagtaatgttgataatgttttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 592 - DNA, 333 bp, Artificial
  Humanized antibody sequence
gcctatgatatgacccagactccagcctctgtggaggtagctgtgggaggcacagtcaccatcaagtgccaggccagtgagagcattagtagctacttagcctggtatcagcagaaatcagggcagcctcccaagctcctgatctacagggcttccactctggcatctggggtctcatcgcggttcaaaggcagtggatctgggacacagttcactctcaccatcagcggcgtggagtgtgccgatgctgccacttactactgtcaacagggtgatgcttggagtaatgttgataatgttttcggcggagggaccgaggtggtggtcaaacgt

SEQ ID NO: 593 - DNA, 69 bp, Oryctolagus cuniculus; identical to SEQ ID NO: 273

SEQ ID NO: 594 - DNA, 33 bp, Oryctolagus cuniculus
caggccagtgagagcattagtagctacttagcc

SEQ ID NO: 595 - DNA, 45 bp, Oryctolagus cuniculus; identical to SEQ ID NO: 555

SEQ ID NO: 596 - DNA, 21 bp, Oryctolagus cuniculus
agggcttccactctggcatct

SEQ ID NO: 597 - DNA, 96 bp, Oryctolagus cuniculus
ggggtctcatcgcggttcaaaggcagtggatctgggacacagttcactctcaccatcagcggcgtggagtgtgccgatgctgccacttactactgt

SEQ ID NO: 598 - DNA, 36 bp, Oryctolagus cuniculus; identical to SEQ ID NO: 558

SEQ ID NO: 599 - DNA, 33 bp, Artificial; identical to SEQ ID NO: 39
  Humanized antibody sequence

SEQ ID NO: 600 - DNA, 318 bp, Artificial; identical to SEQ ID NO: 80
  Humanized antibody sequence

SEQ ID NO: 601 - protein, 449 aa, Artificial
  Humanized antibody sequence
QSVEESGGRLVTPGTPLTLTCTVSGIDLSNYAMGWVRQAPGKGLEYIGMIGVNGRAWYATWAKGRFTISKTSPTVDLKITSPTTEDTATYFCARLIDERSTYSYVFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 602 - protein, 119 aa, Artificial
  Humanized antibody sequence
QSVEESGGRLVTPGTPLTLTCTVSGIDLSNYAMGWVRQAPGKGLEYIGMIGVNGRAWYATWAKGRFTISKTSPTVDLKITSPTTEDTATYFCARLIDERSTYSYVFDLWGQGTLVTVSS

SEQ ID NO: 603 - protein, 29 aa, Oryctolagus cuniculus
QSVEESGGRLVTPGTPLTLTCTVSGIDLS

SEQ ID NO: 604 - protein, 5 aa, Oryctolagus cuniculus
NYAMG

SEQ ID NO: 605 - protein, 14 aa, Oryctolagus cuniculus
WVRQAPGKGLEYIG

SEQ ID NO: 606 - protein, 16 aa, Oryctolagus cuniculus
MIGVNGRAWYATWAKG

SEQ ID NO: 607 - protein, 30 aa, Oryctolagus cuniculus
RFTISKTSPTVDLKITSPTTEDTATYFCAR

SEQ ID NO: 608 - protein, 14 aa, Oryctolagus cuniculus
LIDERSTYSYVFDL

SEQ ID NO: 609 - protein, 11 aa, Artificial
  Humanized antibody sequence
WGQGTLVTVSS

SEQ ID NO: 610 - protein, 330 aa, Artificial; identical to SEQ ID NO: 10
  Humanized antibody sequence

SEQ ID NO: 611 - DNA, 1347 bp, Artificial
  Humanized antibody sequence
cagtcggtggaggagtccgggggtcgcctggtcacgcctgggacacccctgacactcacctgcacagtctctggaatcgacctcagtaattatgcaatgggctgggtccgccaggctccagggaaggggctggaatacatcggaatgattggtgttaatggtagggcatggtacgcgacttgggcgaaaggccgattcaccatctccaagacctcgcccacggtggatctgaaaatcaccagtccgacaaccgaggacacggccacctatttctgtgccagattgattgacgagcgttcaacttatagttatgtttttgacttgtggggccaaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 612 - DNA, 357 bp, Artificial
  Humanized antibody sequence
cagtcggtggaggagtccgggggtcgcctggtcacgcctgggacacccctgacactcacctgcacagtctctggaatcgacctcagtaattatgcaatgggctgggtccgccaggctccagggaaggggctggaatacatcggaatgattggtgttaatggtagggcatggtacgcgacttgggcgaaaggccgattcaccatctccaagacctcgcccacggtggatctgaaaatcaccagtccgacaaccgaggacacggccacctatttctgtgccagattgattgacgagcgttcaacttatagttatgtttttgacttgtggggccaaggcaccctggtcaccgtctcgagc

SEQ ID NO: 613 - DNA, 87 bp, Oryctolagus cuniculus
cagtcggtggaggagtccgggggtcgcctggtcacgcctgggacacccctgacactcacctgcacagtctctggaatcgacctcagt

SEQ ID NO: 614 - DNA, 15 bp, Oryctolagus cuniculus
aattatgcaatgggc

SEQ ID NO: 615 - DNA, 42 bp, Oryctolagus cuniculus
tgggtccgccaggctccagggaaggggctggaatacatcgga

SEQ ID NO: 616 - DNA, 48 bp, Oryctolagus cuniculus
atgattggtgttaatggtagggcatggtacgcgacttgggcgaaaggc

SEQ ID NO: 617 - DNA, 90 bp, Oryctolagus cuniculus
cgattcaccatctccaagacctcgcccacggtggatctgaaaatcaccagtccgacaaccgaggacacggccacctatttctgtgccaga

SEQ ID NO: 618 - DNA, 42 bp, Oryctolagus cuniculus
ttgattgacgagcgttcaacttatagttatgtttttgacttg

SEQ ID NO: 619 - DNA, 33 bp, Artificial
  Humanized antibody sequence
tggggccaaggcaccctggtcaccgtctcgagc

SEQ ID NO: 620 - DNA, 990 bp, Artificial; identical to SEQ ID NO: 20
  Humanized antibody sequence

SEQ ID NO: 621 - protein, 219 aa, Artificial
  Humanized antibody sequence
QVLTQTPSPVSAAVGGTVTINCQGSQSLYNNNAFSWYQQKPGQPPKLLIYDASTLASGVPSRFKGSGSGTQFTLTISGVQCADAATYYCQGEFSCGDVDCIAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 622 - protein, 113 aa, Artificial
  Humanized antibody sequence
QVLTQTPSPVSAAVGGTVTINCQGSQSLYNNNAFSWYQQKPGQPPKLLIYDASTLASGVPSRFKGSGSGTQFTLTISGVQCADAATYYCQGEFSCGDVDCIAFGGGTEVVVKR

SEQ ID NO: 623 - protein, 22 aa, Oryctolagus cuniculus
QVLTQTPSPVSAAVGGTVTINC

SEQ ID NO: 624 - protein, 13 aa, Oryctolagus cuniculus
QGSQSLYNNNAFS

SEQ ID NO: 625 - protein, 15 aa, Oryctolagus cuniculus
WYQQKPGQPPKLLIY

SEQ ID NO: 626 - protein, 7 aa, Oryctolagus cuniculus
DASTLAS

SEQ ID NO: 627 - protein, 32 aa, Oryctolagus cuniculus
GVPSRFKGSGSGTQFTLTISGVQCADAATYYC

SEQ ID NO: 628 - protein, 13 aa, Oryctolagus cuniculus
QGEFSCGDVDCIA

SEQ ID NO: 629 - protein, 11 aa, Artificial
  Humanized antibody sequence
FGGGTEVVVKR

SEQ ID NO: 630 - protein, 106 aa, Artificial; identical to SEQ ID NO: 30
  Humanized antibody sequence

SEQ ID NO: 631 - DNA, 657 bp, Artificial
  Humanized antibody sequence
caagtgctgacccagactccatcccctgtgtctgcagctgtgggaggcacagtcaccatcaactgccagggcagtcagagtctttataataacaacgccttttcctggtatcagcagaaaccagggcagcctcccaagctcctgatctatgatgcttccactctggcgtctggggtcccatcgcggttcaaaggcagtggatctgggacacagttcactctcaccatcagtggcgtgcagtgtgcagatgctgccacttactactgtcaaggcgaatttagttgtggtgatgttgattgtattgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 632 - DNA, 339 bp, Artificial
  Humanized antibody sequence
caagtgctgacccagactccatcccctgtgtctgcagctgtgggaggcacagtcaccatcaactgccagggcagtcagagtctttataataacaacgccttttcctggtatcagcagaaaccagggcagcctcccaagctcctgatctatgatgcttccactctggcgtctggggtcccatcgcggttcaaaggcagtggatctgggacacagttcactctcaccatcagtggcgtgcagtgtgcagatgctgccacttactactgtcaaggcgaatttagttgtggtgatgttgattgtattgctttcggcggagggaccgaggtggtggtcaaacgt

SEQ ID NO: 633 - DNA, 66 bp, Oryctolagus cuniculus
caagtgctgacccagactccatcccctgtgtctgcagctgtgggaggcacagtcaccatcaactgc

SEQ ID NO: 634 - DNA, 39 bp, Oryctolagus cuniculus
cagggcagtcagagtctttataataacaacgccttttcc

SEQ ID NO: 635 - DNA, 45 bp, Oryctolagus cuniculus; identical to SEQ ID NO: 195

SEQ ID NO: 636 - DNA, 21 bp, Oryctolagus cuniculus
gatgcttccactctggcgtct

SEQ ID NO: 637 - DNA, 96 bp, Oryctolagus cuniculus
ggggtcccatcgcggttcaaaggcagtggatctgggacacagttcactctcaccatcagtggcgtgcagtgtgcagatgctgccacttactactgt

SEQ ID NO: 638 - DNA, 39 bp, Oryctolagus cuniculus
caaggcgaatttagttgtggtgatgttgattgtattgct

SEQ ID NO: 639 - DNA, 33 bp, Artificial; identical to SEQ ID NO: 39
  Humanized antibody sequence

SEQ ID NO: 640 - DNA, 318 bp, Artificial; identical to SEQ ID NO: 80
  Humanized antibody sequence

SEQ ID NO: 641 - protein, 449 aa, Artificial
  Humanized antibody sequence
QSVEESGGRLVPPGTPLTLTCTVSGIDLSSYAMGWVRQAPGKGLEYIGMIDVSGSTYYADWAKGRLTISKTPTTVDLEITSPTTEDTATYFCARLIDERSTYSYAFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 119 aa, Artificial
  Humanized antibody sequence
QSVEESGGRLVPPGTPLTLTCTVSGIDLSSYAMGWVRQAPGKGLEYIGMIDVSGSTYYADWAKGRLTISKTPTTVDLEITSPTTEDTATYFCARLIDERSTYSYAFDLWGQGTLVTVSS

SEQ ID NO: 643 - protein, 29 aa, Oryctolagus cuniculus
QSVEESGGRLVPPGTPLTLTCTVSGIDLS

SEQ ID NO: 644 - protein, 5 aa, Oryctolagus cuniculus
SYAMG

SEQ ID NO: 645 - protein, 14 aa, Oryctolagus cuniculus
WVRQAPGKGLEYIG

SEQ ID NO: 646 - protein, 16 aa, Oryctolagus cuniculus
MIDVSGSTYYADWAKG

SEQ ID NO: 647 - protein, 30 aa, Oryctolagus cuniculus
RLTISKTPTTVDLEITSPTTEDTATYFCAR

SEQ ID NO: 648 - protein, 14 aa, Oryctolagus cuniculus
LIDERSTYSYAFDL

SEQ ID NO: 649 - protein, 11 aa, Artificial
  Humanized antibody sequence
WGQGTLVTVSS

SEQ ID NO: 650 - protein, 330 aa, Artificial; identical to SEQ ID NO: 10
  Humanized antibody sequence

SEQ ID NO: 651 - DNA, 1347 bp, Artificial
  Humanized antibody sequence
cagtcggtggaggagtccgggggtcgcctggtcccgcctgggacacccctgacactcacctgcacagtctctggaatcgacctcagtagctatgcaatgggctgggtccgccaggctccagggaaggggctggaatacatcggaatgattgatgttagtggtagcacgtactacgcggactgggcgaaaggccgactcaccatctccaaaaccccgaccacggtggatctggaaatcaccagtccgacaaccgaggacacggccacctatttctgtgccagattgattgacgagcgttcaacttatagttatgcttttgacttgtggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 652 - DNA, 357 bp, Artificial
  Humanized antibody sequence
cagtcggtggaggagtccgggggtcgcctggtcccgcctgggacacccctgacactcacctgcacagtctctggaatcgacctcagtagctatgcaatgggctgggtccgccaggctccagggaaggggctggaatacatcggaatgattgatgttagtggtagcacgtactacgcggactgggcgaaaggccgactcaccatctccaaaaccccgaccacggtggatctggaaatcaccagtccgacaaccgaggacacggccacctatttctgtgccagattgattgacgagcgttcaacttatagttatgcttttgacttgtggggccaaggcaccctcgtcaccgtctcgagc

SEQ ID NO: 653 - DNA, 87 bp, Oryctolagus cuniculus
cagtcggtggaggagtccgggggtcgcctggtcccgcctgggacacccctgacactcacctgcacagtctctggaatcgacctcagt

SEQ ID NO: 654 - DNA, 15 bp, Oryctolagus cuniculus
agctatgcaatgggc

SEQ ID NO: 655 - DNA, 42 bp, Oryctolagus cuniculus; identical to SEQ ID NO: 615

SEQ ID NO: 656 - DNA, 48 bp, Oryctolagus cuniculus
atgattgatgttagtggtagcacgtactacgcggactgggcgaaaggc

SEQ ID NO: 657 - DNA, 90 bp, Oryctolagus cuniculus
cgactcaccatctccaaaaccccgaccacggtggatctggaaatcaccagtccgacaaccgaggacacggccacctatttctgtgccaga

SEQ ID NO: 658 - DNA, 42 bp, Oryctolagus cuniculus
ttgattgacgagcgttcaacttatagttatgcttttgacttg

SEQ ID NO: 659 - DNA, 33 bp, Artificial
  Humanized antibody sequence
tggggccaaggcaccctcgtcaccgtctcgagc

SEQ ID NO: 660 - DNA, 990 bp, Artificial; identical to SEQ ID NO: 20
  Humanized antibody sequence

SEQ ID NO: 661 - protein, 219 aa, Artificial
  Humanized antibody sequence
QVLTQTPSPVSAAVGGTVTINCQASQSFYNNGAFSWYQQKPGQPPKLLIYDASTLASGVPSRFKGSGSGTQFTLTISGVQCGDAATYYCQGEFSCGSADCVAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 662 - protein, 113 aa, Artificial
  Humanized antibody sequence
QVLTQTPSPVSAAVGGTVTINCQASQSFYNNGAFSWYQQKPGQPPKLLIYDASTLASGVPSRFKGSGSGTQFTLTISGVQCGDAATYYCQGEFSCGSADCVAFGGGTEVVVKR

SEQ ID NO: 663 - protein, 22 aa, Oryctolagus cuniculus
QVLTQTPSPVSAAVGGTVTINC

SEQ ID NO: 664 - protein, 13 aa, Oryctolagus cuniculus
QASQSFYNNGAFS

SEQ ID NO: 665 - protein, 15 aa, Oryctolagus cuniculus
WYQQKPGQPPKLLIY

SEQ ID NO: 666 - protein, 7 aa, Oryctolagus cuniculus
DASTLAS

SEQ ID NO: 667 - protein, 32 aa, Oryctolagus cuniculus
GVPSRFKGSGSGTQFTLTISGVQCGDAATYYC

SEQ ID NO: 668 - protein, 13 aa, Oryctolagus cuniculus
QGEFSCGSADCVA

SEQ ID NO: 669 - protein, 11 aa, Artificial
  Humanized antibody sequence
FGGGTEVVVKR

SEQ ID NO: 670 - protein, 106 aa, Artificial; identical to SEQ ID NO: 30
  Humanized antibody sequence

SEQ ID NO: 671 - DNA, 657 bp, Artificial
  Humanized antibody sequence
caagtgctgacccagactccatcccctgtgtctgcagctgtgggaggcacagtcaccatcaactgccaggccagtcagagtttttataataacggcgccttttcctggtatcagcagaaaccagggcagcctcccaagctcctgatctacgatgcatccactctggcatctggggtcccatcgcggttcaaaggcagtggatctgggacacagttcactctcaccatcagcggcgtacagtgtggagatgctgccacttactactgtcaaggcgaatttagttgtggtagtgctgattgtgttgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 672 - DNA, 339 bp, Artificial
  Humanized antibody sequence
caagtgctgacccagactccatcccctgtgtctgcagctgtgggaggcacagtcaccatcaactgccaggccagtcagagtttttataataacggcgccttttcctggtatcagcagaaaccagggcagcctcccaagctcctgatctacgatgcatccactctggcatctggggtcccatcgcggttcaaaggcagtggatctgggacacagttcactctcaccatcagcggcgtacagtgtggagatgctgccacttactactgtcaaggcgaatttagttgtggtagtgctgattgtgttgctttcggcggagggaccgaggtggtggtcaaacgt

SEQ ID NO: 673 - DNA, 66 bp, Oryctolagus cuniculus; identical to SEQ ID NO: 633

SEQ ID NO: 674 - DNA, 39 bp, Oryctolagus cuniculus
caggccagtcagagtttttataataacggcgccttttcc

SEQ ID NO: 675 - DNA, 45 bp, Oryctolagus cuniculus; identical to SEQ ID NO: 35

SEQ ID NO: 676 - DNA, 21 bp, Oryctolagus cuniculus
gatgcatccactctggcatct

SEQ ID NO: 677 - DNA, 96 bp, Oryctolagus cuniculus
ggggtcccatcgcggttcaaaggcagtggatctgggacacagttcactctcaccatcagcggcgtacagtgtggagatgctgccacttactactgt

SEQ ID NO: 678 - DNA, 39 bp, Oryctolagus cuniculus
caaggcgaatttagttgtggtagtgctgattgtgttgct

SEQ ID NO: 679 - DNA, 33 bp, Artificial; identical to SEQ ID NO: 39
  Humanized antibody sequence

SEQ ID NO: 680 - DNA, 318 bp, Artificial; identical to SEQ ID NO: 80
  Humanized antibody sequence

SEQ ID NO: 681 - protein, 450 aa, Artificial
  Humanized antibody sequence
QSLEESGGRLVTPGTPLTLTCTASGFSLSSYDMSWVRQAPGKGLEWIGIIYAGSASTWFASWVKGRFTISKTSTTVDLKMTSLTTEDTATYFCARVGYSGYGYDDNLDMWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 682 - protein, 120 aa, Artificial
  Humanized antibody sequence
QSLEESGGRLVTPGTPLTLTCTASGFSLSSYDMSWVRQAPGKGLEWIGIIYAGSASTWFASWVKGRFTISKTSTTVDLKMTSLTTEDTATYFCARVGYSGYGYDDNLDMWGQGTLVTVSS

SEQ ID NO: 683 - protein, 29 aa, Oryctolagus cuniculus
QSLEESGGRLVTPGTPLTLTCTASGFSLS

SEQ ID NO: 684 - protein, 5 aa, Oryctolagus cuniculus
SYDMS

SEQ ID NO: 685 - protein, 14 aa, Oryctolagus cuniculus
WVRQAPGKGLEWIG

SEQ ID NO: 686 - protein, 17 aa, Oryctolagus cuniculus
IIYAGSASTWFASWVKG

SEQ ID NO: 687 - protein, 30 aa, Oryctolagus cuniculus
RFTISKTSTTVDLKMTSLTTEDTATYFCAR

SEQ ID NO: 688 - protein, 14 aa, Oryctolagus cuniculus
VGYSGYGYDDNLDM

SEQ ID NO: 689 - protein, 11 aa, Artificial
  Humanized antibody sequence
WGQGTLVTVSS

SEQ ID NO: 690 - protein, 330 aa, Artificial; identical to SEQ ID NO: 10
  Humanized antibody sequence

SEQ ID NO: 691 - DNA, 1350 bp, Artificial
  Humanized antibody sequence
cagtcgctggaggagtccgggggtcgcctggtcacgcctgggacacccctgacactcacctgcacagcctctggattctccctcagcagctacgacatgagctgggtccgccaggctccagggaaggggctggaatggatcggaatcatttatgctggtagtgctagcacatggttcgcgagctgggtgaaaggccgattcaccatctccaaaacctcgaccacggtggatctgaaaatgaccagtctgacaaccgaggacacggccacctatttctgtgccagagtgggttatagtggttatggttatgatgataatttggacatgtggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 692 - DNA, 360 bp, Artificial
  Humanized antibody sequence
cagtcgctggaggagtccgggggtcgcctggtcacgcctgggacacccctgacactcacctgcacagcctctggattctccctcagcagctacgacatgagctgggtccgccaggctccagggaaggggctggaatggatcggaatcatttatgctggtagtgctagcacatggttcgcgagctgggtgaaaggccgattcaccatctccaaaacctcgaccacggtggatctgaaaatgaccagtctgacaaccgaggacacggccacctatttctgtgccagagtgggttatagtggttatggttatgatgataatttggacatgtggggccaaggcaccctcgtcaccgtctcgagc

SEQ ID NO: 693 - DNA, 87 bp, Oryctolagus cuniculus
cagtcgctggaggagtccgggggtcgcctggtcacgcctgggacacccctgacactcacctgcacagcctctggattctccctcagc

SEQ ID NO: 694 - DNA, 15 bp, Oryctolagus cuniculus
agctacgacatgagc

SEQ ID NO: 695 - DNA, 42 bp, Oryctolagus cuniculus; identical to SEQ ID NO: 95

SEQ ID NO: 696 - DNA, 51 bp, Oryctolagus cuniculus
atcatttatgctggtagtgctagcacatggttcgcgagctgggtgaaaggc

SEQ ID NO: 697 - DNA, 90 bp, Oryctolagus cuniculus
cgattcaccatctccaaaacctcgaccacggtggatctgaaaatgaccagtctgacaaccgaggacacggccacctatttctgtgccaga

SEQ ID NO: 698 - DNA, 42 bp, Oryctolagus cuniculus
gtgggttatagtggttatggttatgatgataatttggacatg

SEQ ID NO: 699 - DNA, 33 bp, Artificial; identical to SEQ ID NO: 659
  Humanized antibody sequence

SEQ ID NO: 700 - DNA, 990 bp, Artificial; identical to SEQ ID NO: 20
  Humanized antibody sequence

SEQ ID NO: 701 - protein, 217 aa, Artificial
  Humanized antibody sequence
AYDMTQTPASVEVAVGGTVTIKCQASQSISTALAWYQQKPGQRPKLLIYDASKLASGVSSRFKGSGSGAQFTLTISGVECADAATYYCHQGYSSSNVDNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 702 - protein, 111 aa, Artificial
  Humanized antibody sequence
AYDMTQTPASVEVAVGGTVTIKCQASQSISTALAWYQQKPGQRPKLLIYDASKLASGVSSRFKGSGSGAQFTLTISGVECADAATYYCHQGYSSSNVDNTFGGGTEVVVKR

SEQ ID NO: 703 - protein, 23 aa, Oryctolagus cuniculus
AYDMTQTPASVEVAVGGTVTIKC

SEQ ID NO: 704 - protein, 11 aa, Oryctolagus cuniculus
QASQSISTALA

SEQ ID NO: 705 - protein, 15 aa, Oryctolagus cuniculus
WYQQKPGQRPKLLIY

SEQ ID NO: 706 - protein, 7 aa, Oryctolagus cuniculus
DASKLAS

SEQ ID NO: 707 - protein, 32 aa, Oryctolagus cuniculus
GVSSRFKGSGSGAQFTLTISGVECADAATYYC

SEQ ID NO: 708 - protein, 12 aa, Oryctolagus cuniculus
HQGYSSSNVDNT

SEQ ID NO: 709 - protein, 11 aa, Artificial
  Humanized antibody sequence
FGGGTEVVVKR

SEQ ID NO: 710 - protein, 106 aa, Artificial; identical to SEQ ID NO: 30
  Humanized antibody sequence

SEQ ID NO: 711 - DNA, 651 bp, Artificial
  Humanized antibody sequence
gcctatgatatgacccagactccagcctctgtggaggtagctgtgggaggcacagtcaccatcaagtgccaggccagtcagagcattagcactgcattagcctggtatcagcagaaaccagggcagcgtcccaagctcctgatctacgatgcatcgaaactggcatctggggtctcatcgcggttcaaaggcagtggatctggggcacagttcactctcaccatcagcggcgtggagtgtgccgatgctgccacttactactgtcaccagggttatagtagtagtaatgttgataatactttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 712 - DNA, 333 bp, Artificial
  Humanized antibody sequence
gcctatgatatgacccagactccagcctctgtggaggtagctgtgggaggcacagtcaccatcaagtgccaggccagtcagagcattagcactgcattagcctggtatcagcagaaaccagggcagcgtcccaagctcctgatctacgatgcatcgaaactggcatctggggtctcatcgcggttcaaaggcagtggatctggggcacagttcactctcaccatcagcggcgtggagtgtgccgatgctgccacttactactgtcaccagggttatagtagtagtaatgttgataatactttcggcggagggaccgaggtggtggtcaaacgt

SEQ ID NO: 713 - DNA, 69 bp, Oryctolagus cuniculus; identical to SEQ ID NO: 273

SEQ ID NO: 714 - DNA, 33 bp, Oryctolagus cuniculus
caggccagtcagagcattagcactgcattagcc

SEQ ID NO: 715 - DNA, 45 bp, Oryctolagus cuniculus
tggtatcagcagaaaccagggcagcgtcccaagctcctgatctac

SEQ ID NO: 716 - DNA, 21 bp, Oryctolagus cuniculus
gatgcatcgaaactggcatct

SEQ ID NO: 717 - DNA, 96 bp, Oryctolagus cuniculus
ggggtctcatcgcggttcaaaggcagtggatctggggcacagttcactctcaccatcagcggcgtggagtgtgccgatgctgccacttactactgt

SEQ ID NO: 718 - DNA, 36 bp, Oryctolagus cuniculus
caccagggttatagtagtagtaatgttgataatact

SEQ ID NO: 719 - DNA, 33 bp, Artificial; identical to SEQ ID NO: 39
  Humanized antibody sequence

SEQ ID NO: 720 - DNA, 318 bp, Artificial; identical to SEQ ID NO: 80
  Humanized antibody sequence

SEQ ID NO: 721 - protein, 448 aa, Artificial
  Humanized antibody sequence
QSVEESGGRLVTPGTPLTLTCTASGFSLSNYWMGWVRQAPGEGLEWIGTISYDGNTYYASWAKGRFTISRTSTTVDLKMTSLTTEDTAIYFCATVNYPDYSTGAFNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 118 aa, Artificial
  Humanized antibody sequence
QSVEESGGRLVTPGTPLTLTCTASGFSLSNYWMGWVRQAPGEGLEWIGTISYDGNTYYASWAKGRFTISRTSTTVDLKMTSLTTEDTAIYFCATVNYPDYSTGAFNIWGPGTLVTVSS

SEQ ID NO: 723 - protein, 29 aa, Oryctolagus cuniculus
QSVEESGGRLVTPGTPLTLTCTASGFSLS

SEQ ID NO: 724 - protein, 5 aa, Oryctolagus cuniculus
NYWMG

SEQ ID NO: 725 - protein, 14 aa, Oryctolagus cuniculus
WVRQAPGEGLEWIG

SEQ ID NO: 726 - protein, 16 aa, Oryctolagus cuniculus
TISYDGNTYYASWAKG

SEQ ID NO: 727 - protein, 30 aa, Oryctolagus cuniculus
RFTISRTSTTVDLKMTSLTTEDTAIYFCAT

SEQ ID NO: 728 - protein, 13 aa, Oryctolagus cuniculus
VNYPDYSTGAFNI

SEQ ID NO: 729 - protein, 11 aa, Artificial
  Humanized antibody sequence
WGPGTLVTVSS

SEQ ID NO: 730 - protein, 330 aa, Artificial; identical to SEQ ID NO: 10
  Humanized antibody sequence

SEQ ID NO: 731 - DNA, 1344 bp, Artificial
  Humanized antibody sequence
cagtcggtggaggagtccgggggtcgcctggtcacgcctgggacacccctgacactcacctgcacagcctctggattctccctcagtaattattggatgggctgggtccgccaggctccaggggaggggctggaatggatcggaaccattagttatgatggtaacacatactacgcgagctgggcaaaaggccgcttcaccatctcccgaacctcgaccacggtggatctgaaaatgaccagtctgacgaccgaggacacggccatctatttctgtgccacagtcaattatcctgattatagtactggtgcctttaacatctggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 732 - DNA, 354 bp, Artificial
  Humanized antibody sequence
cagtcggtggaggagtccgggggtcgcctggtcacgcctgggacacccctgacactcacctgcacagcctctggattctccctcagtaattattggatgggctgggtccgccaggctccaggggaggggctggaatggatcggaaccattagttatgatggtaacacatactacgcgagctgggcaaaaggccgcttcaccatctcccgaacctcgaccacggtggatctgaaaatgaccagtctgacgaccgaggacacggccatctatttctgtgccacagtcaattatcctgattatagtactggtgcctttaacatctggggcccaggcaccctcgtcaccgtctcgagc

SEQ ID NO: 733 - DNA, 87 bp, Oryctolagus cuniculus
cagtcggtggaggagtccgggggtcgcctggtcacgcctgggacacccctgacactcacctgcacagcctctggattctccctcagt

SEQ ID NO: 734 - DNA, 15 bp, Oryctolagus cuniculus
aattattggatgggc

SEQ ID NO: 735 - DNA, 42 bp, Oryctolagus cuniculus; identical to SEQ ID NO: 335

SEQ ID NO: 736 - DNA, 48 bp, Oryctolagus cuniculus
accattagttatgatggtaacacatactacgcgagctgggcaaaaggc

SEQ ID NO: 737 - DNA, 90 bp, Oryctolagus cuniculus
cgcttcaccatctcccgaacctcgaccacggtggatctgaaaatgaccagtctgacgaccgaggacacggccatctatttctgtgccaca

SEQ ID NO: 738 - DNA, 39 bp, Oryctolagus cuniculus
gtcaattatcctgattatagtactggtgcctttaacatc

SEQ ID NO: 739 - DNA, 33 bp, Artificial; identical to SEQ ID NO: 179
  Humanized antibody sequence

SEQ ID NO: 740 - DNA, 990 bp, Artificial; identical to SEQ ID NO: 20
  Humanized antibody sequence

SEQ ID NO: 741 - protein, 217 aa, Artificial
  Humanized antibody sequence
DVVMTQTPASVSEPVGGTVTIKCQASQSIDNYLAWYQQKPGQRPRLLIYYTSTLASGVPSRFKGSGSGTEYTLTISDLECADAATYYCQFTAYYSTYIGAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 111 aa, Artificial
  Humanized antibody sequence
DVVMTQTPASVSEPVGGTVTIKCQASQSIDNYLAWYQQKPGQRPRLLIYYTSTLASGVPSRFKGSGSGTEYTLTISDLECADAATYYCQFTAYYSTYIGAFGGGTEVVVKR

SEQ ID NO: 743 - protein, 23 aa, Oryctolagus cuniculus
DVVMTQTPASVSEPVGGTVTIKC

SEQ ID NO: 744 - protein, 11 aa, Oryctolagus cuniculus
QASQSIDNYLA

SEQ ID NO: 745 - protein, 15 aa, Oryctolagus cuniculus
WYQQKPGQRPRLLIY

SEQ ID NO: 746 - protein, 7 aa, Oryctolagus cuniculus
YTSTLAS

SEQ ID NO: 747 - protein, 32 aa, Oryctolagus cuniculus
GVPSRFKGSGSGTEYTLTISDLECADAATYYC

SEQ ID NO: 748 - protein, 12 aa, Oryctolagus cuniculus
QFTAYYSTYIGA

SEQ ID NO: 749 - protein, 11 aa, Artificial
  Humanized antibody sequence
FGGGTEVVVKR

SEQ ID NO: 750 - protein, 106 aa, Artificial; identical to SEQ ID NO: 30
  Humanized antibody sequence

SEQ ID NO: 751 - DNA, 651 bp, Artificial
  Humanized antibody sequence
gatgttgtgatgacccagactccagcctccgtgtctgaacctgtgggaggcacagtcaccatcaagtgccaggccagtcagagcattgataactacttagcctggtatcagcagaaaccagggcagcgtcccaggctcctgatctattatacatccactctggcatctggggtcccatcgcggttcaaaggcagtggatctgggacagagtacactctcaccatcagcgacctggagtgtgccgatgctgccacttactactgtcaatttactgcttattatagtacttatattggagctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 752 - DNA, 333 bp, Artificial
  Humanized antibody sequence
gatgttgtgatgacccagactccagcctccgtgtctgaacctgtgggaggcacagtcaccatcaagtgccaggccagtcagagcattgataactacttagcctggtatcagcagaaaccagggcagcgtcccaggctcctgatctattatacatccactctggcatctggggtcccatcgcggttcaaaggcagtggatctgggacagagtacactctcaccatcagcgacctggagtgtgccgatgctgccacttactactgtcaatttactgcttattatagtacttatattggagctttcggcggagggaccgaggtggtggtcaaacgt

SEQ ID NO: 753 - DNA, 69 bp, Oryctolagus cuniculus
gatgttgtgatgacccagactccagcctccgtgtctgaacctgtgggaggcacagtcaccatcaagtgc

SEQ ID NO: 754 - DNA, 33 bp, Oryctolagus cuniculus
caggccagtcagagcattgataactacttagcc

SEQ ID NO: 755 - DNA, 45 bp, Oryctolagus cuniculus
tggtatcagcagaaaccagggcagcgtcccaggctcctgatctat

SEQ ID NO: 756 - DNA, 21 bp, Oryctolagus cuniculus
tatacatccactctggcatct

SEQ ID NO: 757 - DNA, 96 bp, Oryctolagus cuniculus
ggggtcccatcgcggttcaaaggcagtggatctgggacagagtacactctcaccatcagcgacctggagtgtgccgatgctgccacttactactgt

SEQ ID NO: 758 - DNA, 36 bp, Oryctolagus cuniculus
caatttactgcttattatagtacttatattggagct

SEQ ID NO: 759 - DNA, 33 bp, Artificial; identical to SEQ ID NO: 39
  Humanized antibody sequence

SEQ ID NO: 760 - DNA, 318 bp, Artificial; identical to SEQ ID NO: 80
  Humanized antibody sequence

SEQ ID NO: 761 - protein, 451 aa, Artificial
  Humanized antibody sequence
EVQLVESGGGLVQPGGSLRLSCAASGFTVSNYWMGWVRQAPGKGLEWIGTISYDGNTYYASSAKGRFTISRDNSKNTLYLQMNSLRAEDTAVYYCATVNYPDYSTGAFNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 762 - protein, 121 aa, Artificial
  Humanized antibody sequence
EVQLVESGGGLVQPGGSLRLSCAASGFTVSNYWMGWVRQAPGKGLEWIGTISYDGNTYYASSAKGRFTISRDNSKNTLYLQMNSLRAEDTAVYYCATVNYPDYSTGAFNIWGQGTLVTVSS

SEQ ID NO: 763 - protein, 30 aa, Artificial; identical to SEQ ID NO: 43
  Humanized antibody sequence

SEQ ID NO: 764 - protein, 5 aa, Oryctolagus cuniculus
NYWMG

SEQ ID NO: 765 - protein, 14 aa, Artificial
  Humanized antibody sequence
WVRQAPGKGLEWIG

SEQ ID NO: 766 - protein, 16 aa, Artificial
  Humanized antibody sequence
TISYDGNTYYASSAKG

SEQ ID NO: 767 - protein, 32 aa, Artificial
  Humanized antibody sequence
RFTISRDNSKNTLYLQMNSLRAEDTAVYYCAT

SEQ ID NO: 768 - protein, 13 aa, Oryctolagus cuniculus
VNYPDYSTGAFNI

SEQ ID NO: 769 - protein, 11 aa, Artificial
  Humanized antibody sequence
WGQGTLVTVSS

SEQ ID NO: 770 - protein, 330 aa, Artificial; identical to SEQ ID NO: 10
  Humanized antibody sequence

SEQ ID NO: 771 - DNA, 1353 bp, Artificial
  Humanized antibody sequence
gaggtgcagctggtggagtctgggggaggcttggtccagcctggggggtccctgagactctcctgtgcagcctctggattcaccgtcagtaactattggatgggctgggtccgtcaggctccagggaaggggctggagtggatcggaaccattagttatgatggtaacacatactacgcgagcagcgcaaaaggccgattcaccatctccagagacaattccaagaacaccctgtatcttcaaatgaacagcctgagagctgaggacactgctgtgtattactgtgctacagtcaattatcctgattatagtactggtgcctttaacatctggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 772 - DNA, 363 bp, Artificial
  Humanized antibody sequence
gaggtgcagctggtggagtctgggggaggcttggtccagcctggggggtccctgagactctcctgtgcagcctctggattcaccgtcagtaactattggatgggctgggtccgtcaggctccagggaaggggctggagtggatcggaaccattagttatgatggtaacacatactacgcgagcagcgcaaaaggccgattcaccatctccagagacaattccaagaacaccctgtatcttcaaatgaacagcctgagagctgaggacactgctgtgtattactgtgctacagtcaattatcctgattatagtactggtgcctttaacatctggggccaagggaccctcgtcaccgtctcgagc

SEQ ID NO: 773 - DNA, 90 bp, Artificial; identical to SEQ ID NO: 53
  Humanized antibody sequence

SEQ ID NO: 774 - DNA, 15 bp, Artificial
  Humanized antibody sequence
aactattggatgggc

SEQ ID NO: 775 - DNA, 42 bp, Artificial
  Humanized antibody sequence
tgggtccgtcaggctccagggaaggggctggagtggatcgga

SEQ ID NO: 776 - DNA, 48 bp, Artificial
  Humanized antibody sequence
accattagttatgatggtaacacatactacgcgagcagcgcaaaaggc

SEQ ID NO: 777 - DNA, 96 bp, Artificial
  Humanized antibody sequence
cgattcaccatctccagagacaattccaagaacaccctgtatcttcaaatgaacagcctgagagctgaggacactgctgtgtattactgtgctaca

SEQ ID NO: 778 - DNA, 39 bp, Oryctolagus cuniculus; identical to SEQ ID NO: 738

SEQ ID NO: 779 - DNA, 33 bp, Artificial; identical to SEQ ID NO: 59
  Humanized antibody sequence

SEQ ID NO: 780 - DNA, 990 bp, Artificial; identical to SEQ ID NO: 20
  Humanized antibody sequence

SEQ ID NO: 781 - protein, 217 aa, Artificial
  Humanized antibody sequence
DIQMTQSPSSLSASVGDRVTITCQASQSIDNYLAWYQQKPGKVPKLLIYYTSTLASGVPSRFSGSGSGTDFTLTISSLQPEDVATYYCQFTAYYSTYIGAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 782 - protein, 111 aa, Artificial
  Humanized antibody sequence
DIQMTQSPSSLSASVGDRVTITCQASQSIDNYLAWYQQKPGKVPKLLIYYTSTLASGVPSRFSGSGSGTDFTLTISSLQPEDVATYYCQFTAYYSTYIGAFGGGTKVEIKR

SEQ ID NO: 783 - protein, 23 aa, Artificial
  Humanized antibody sequence
DIQMTQSPSSLSASVGDRVTITC

SEQ ID NO: 784 - protein, 11 aa, Oryctolagus cuniculus
QASQSIDNYLA

SEQ ID NO: 785 - protein, 15 aa, Artificial
  Humanized antibody sequence
WYQQKPGKVPKLLIY

SEQ ID NO: 786 - protein, 7 aa, Oryctolagus cuniculus
YTSTLAS

SEQ ID NO: 787 - protein, 32 aa, Artificial
  Humanized antibody sequence
GVPSRFSGSGSGTDFTLTISSLQPEDVATYYC

SEQ ID NO: 788 - protein, 12 aa, Oryctolagus cuniculus
QFTAYYSTYIGA

SEQ ID NO: 789 - protein, 11 aa, Artificial
  Humanized antibody sequence
FGGGTKVEIKR

SEQ ID NO: 790 - protein, 106 aa, Artificial; identical to SEQ ID NO: 30
  Humanized antibody sequence

SEQ ID NO: 791 - DNA, 651 bp, Artificial
  Humanized antibody sequence
gacatccagatgacccagtctccatcctccctgtctgcatctgtaggagacagagtcaccatcacttgccaggccagtcagagcattgataactacttagcctggtatcagcagaaaccagggaaagttcctaagctcctgatctattatacatccactctggcatctggggtcccatctcgtttcagtggcagtggatctgggacagatttcactctcaccatcagcagcctgcagcctgaagatgttgcaacttattactgtcaattcactgcttattatagtacttacattggagctttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 792 - DNA, 333 bp, Artificial
  Humanized antibody sequence
gacatccagatgacccagtctccatcctccctgtctgcatctgtaggagacagagtcaccatcacttgccaggccagtcagagcattgataactacttagcctggtatcagcagaaaccagggaaagttcctaagctcctgatctattatacatccactctggcatctggggtcccatctcgtttcagtggcagtggatctgggacagatttcactctcaccatcagcagcctgcagcctgaagatgttgcaacttattactgtcaattcactgcttattatagtacttacattggagctttcggcggaggaaccaaggtggaaatcaaacgt

SEQ ID NO: 793 - DNA, 69 bp, Artificial
  Humanized antibody sequence
gacatccagatgacccagtctccatcctccctgtctgcatctgtaggagacagagtcaccatcacttgc

SEQ ID NO: 794 - DNA, 33 bp, Oryctolagus cuniculus; identical to SEQ ID NO: 754

SEQ ID NO: 795 - DNA, 45 bp, Artificial
  Humanized antibody sequence
tggtatcagcagaaaccagggaaagttcctaagctcctgatctat

SEQ ID NO: 796 - DNA, 21 bp, Oryctolagus cuniculus
tatacatccactctggcatct

SEQ ID NO: 797 - DNA, 96 bp, Artificial
  Humanized antibody sequence
ggggtcccatctcgtttcagtggcagtggatctgggacagatttcactctcaccatcagcagcctgcagcctgaagatgttgcaacttattactgt

SEQ ID NO: 798 - DNA, 36 bp, Artificial
  Humanized antibody sequence
caattcactgcttattatagtacttacattggagct

SEQ ID NO: 799 - DNA, 33 bp, Artificial; identical to SEQ ID NO: 79
  Humanized antibody sequence

SEQ ID NO: 800 - DNA, 318 bp, Artificial; identical to SEQ ID NO: 40
  Humanized antibody sequence

SEQ ID NO: 801 - protein, 447 aa, Artificial
  Humanized antibody sequence
QSVEESGGRLVTPGTPLTLTCTVSGFSLSTYYMSWVRQAPGKGLEWIGIIYVSGITDYARWAKGRFTISKTSTTVDLKMTSLTTEDTATYFCARHIDSSGWDGLGIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 802 - protein, 117 aa, Artificial
  Humanized antibody sequence
QSVEESGGRLVTPGTPLTLTCTVSGFSLSTYYMSWVRQAPGKGLEWIGIIYVSGITDYARWAKGRFTISKTSTTVDLKMTSLTTEDTATYFCARHIDSSGWDGLGIWGQGTLVTVSS

SEQ ID NO: 803 - protein, 29 aa, Oryctolagus cuniculus
QSVEESGGRLVTPGTPLTLTCTVSGFSLS

SEQ ID NO: 804 - protein, 5 aa, Oryctolagus cuniculus
TYYMS

SEQ ID NO: 805 - protein, 14 aa, Oryctolagus cuniculus
WVRQAPGKGLEWIG

SEQ ID NO: 806 - protein, 16 aa, Oryctolagus cuniculus
IIYVSGITDYARWAKG

SEQ ID NO: 807 - protein, 30 aa, Oryctolagus cuniculus; identical to SEQ ID NO: 687

SEQ ID NO: 808 - protein, 12 aa, Oryctolagus cuniculus
HIDSSGWDGLGI

SEQ ID NO: 809 - protein, 11 aa, Artificial
  Humanized antibody sequence
WGQGTLVTVSS

SEQ ID NO: 810 - protein, 330 aa, Artificial; identical to SEQ ID NO: 10
  Humanized antibody sequence

SEQ ID NO: 811 - DNA, 1341 bp, Artificial
  Humanized antibody sequence
cagtcggtggaggagtccgggggtcgcctggtcacgcctgggacacccctgacactcacctgcaccgtctctggattctccctcagtacctactacatgagctgggtccgccaggctccagggaaggggctggaatggatcggaatcatttatgttagtggtatcacggactacgcgaggtgggcgaaaggccgattcaccatctccaaaacctcgaccacggtggatctgaaaatgaccagtctgacaaccgaggacacggccacctatttctgtgccagacatattgatagtagtggctgggatggactgggcatctggggccaaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 812 - DNA, 351 bp, Artificial
  Humanized antibody sequence
cagtcggtggaggagtccgggggtcgcctggtcacgcctgggacacccctgacactcacctgcaccgtctctggattctccctcagtacctactacatgagctgggtccgccaggctccagggaaggggctggaatggatcggaatcatttatgttagtggtatcacggactacgcgaggtgggcgaaaggccgattcaccatctccaaaacctcgaccacggtggatctgaaaatgaccagtctgacaaccgaggacacggccacctatttctgtgccagacatattgatagtagtggctgggatggactgggcatctggggccaaggcaccctcgtcaccgtctcgagc

SEQ ID NO: 813 - DNA, 87 bp, Oryctolagus cuniculus
cagtcggtggaggagtccgggggtcgcctggtcacgcctgggacacccctgacactcacctgcaccgtctctggattctccctcagt

SEQ ID NO: 814 - DNA, 15 bp, Oryctolagus cuniculus
acctactacatgagc

SEQ ID NO: 815 - DNA, 42 bp, Oryctolagus cuniculus; identical to SEQ ID NO: 95

SEQ ID NO: 816 - DNA, 48 bp, Oryctolagus cuniculus
atcatttatgttagtggtatcacggactacgcgaggtgggcgaaaggc

SEQ ID NO: 817 - DNA, 90 bp, Oryctolagus cuniculus; identical to SEQ ID NO: 697

SEQ ID NO: 818 - DNA, 36 bp, Oryctolagus cuniculus
catattgatagtagtggctgggatggactgggcatc

SEQ ID NO: 819 - DNA, 33 bp, Artificial; identical to SEQ ID NO: 659
  Humanized antibody sequence

SEQ ID NO: 820 - DNA, 990 bp, Artificial; identical to SEQ ID NO: 20
  Humanized antibody sequence

SEQ ID NO: 821 - protein, 217 aa, Artificial
  Humanized antibody sequence
AYDMTQTPASVEVAVGGTVTIKCQASESISSYLNWYQQKLGQPPKLLIYRASTLTSGVSSRFKGSGSGTEYTLTISDLECADAATYYCQQTYGYSDTDNSFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 111 aa, Artificial
  Humanized antibody sequence
AYDMTQTPASVEVAVGGTVTIKCQASESISSYLNWYQQKLGQPPKLLIYRASTLTSGVSSRFKGSGSGTEYTLTISDLECADAATYYCQQTYGYSDTDNSFGGGTEVVVKR

SEQ ID NO: 823 - protein, 23 aa, Oryctolagus cuniculus
AYDMTQTPASVEVAVGGTVTIKC

SEQ ID NO: 824 - protein, 11 aa, Oryctolagus cuniculus
QASESISSYLN

SEQ ID NO: 825 - protein, 15 aa, Oryctolagus cuniculus
WYQQKLGQPPKLLIY

SEQ ID NO: 826 - protein, 7 aa, Oryctolagus cuniculus
RASTLTS

SEQ ID NO: 827 - protein, 32 aa, Oryctolagus cuniculus
GVSSRFKGSGSGTEYTLTISDLECADAATYYC

SEQ ID NO: 828 - protein, 12 aa, Oryctolagus cuniculus
QQTYGYSDTDNS

SEQ ID NO: 829 - protein, 11 aa, Artificial
  Humanized antibody sequence
FGGGTEVVVKR

SEQ ID NO: 830 - protein, 106 aa, Artificial; identical to SEQ ID NO: 30
  Humanized antibody sequence

SEQ ID NO: 831 - DNA, 651 bp, Artificial
  Humanized antibody sequence
gcctatgatatgacccagactccagcctctgtggaggtagctgtgggaggcacagtcaccatcaagtgccaggccagtgagagcattagtagctacttaaactggtatcagcagaaactagggcagcctcccaagctcctgatctacagggcatccactctgacatctggggtctcatcaaggttcaaaggcagtggatctgggacagagtacactctcaccatcagcgacctggagtgtgccgatgctgccacttactactgtcagcagacttatggttatagtgatactgataattctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 832 - DNA, 333 bp, Artificial
  Humanized antibody sequence
gcctatgatatgacccagactccagcctctgtggaggtagctgtgggaggcacagtcaccatcaagtgccaggccagtgagagcattagtagctacttaaactggtatcagcagaaactagggcagcctcccaagctcctgatctacagggcatccactctgacatctggggtctcatcaaggttcaaaggcagtggatctgggacagagtacactctcaccatcagcgacctggagtgtgccgatgctgccacttactactgtcagcagacttatggttatagtgatactgataattctttcggcggagggaccgaggtggtggtcaaacgt

SEQ ID NO: 833 - DNA, 69 bp, Oryctolagus cuniculus; identical to SEQ ID NO: 273

SEQ ID NO: 834 - DNA, 33 bp, Oryctolagus cuniculus
caggccagtgagagcattagtagctacttaaac

SEQ ID NO: 835 - DNA, 45 bp, Oryctolagus cuniculus
tggtatcagcagaaactagggcagcctcccaagctcctgatctac

SEQ ID NO: 836 - DNA, 21 bp, Oryctolagus cuniculus
agggcatccactctgacatct

SEQ ID NO: 837 - DNA, 96 bp, Oryctolagus cuniculus
ggggtctcatcaaggttcaaaggcagtggatctgggacagagtacactctcaccatcagcgacctggagtgtgccgatgctgccacttactactgt

SEQ ID NO: 838 - DNA, 36 bp, Oryctolagus cuniculus
cagcagacttatggttatagtgatactgataattct

SEQ ID NO: 839 - DNA, 33 bp, Artificial; identical to SEQ ID NO: 39
  Humanized antibody sequence

SEQ ID NO: 840 - DNA, 318 bp, Artificial; identical to SEQ ID NO: 80
  Humanized antibody sequence

SEQ ID NO: 841 - protein, 446 aa, Artificial
  Humanized antibody sequence
QSLEESGGRLVTPGTPLTLTCTASGFTIGRYYMSWVRQAPGKGLEWIGIIYTHGVNPDYASWAKGRFTISRPSTTVDLKITSPTTEDTATYFCARVGGFNDYSDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 842 - protein, 116 aa, Artificial
  Humanized antibody sequence
QSLEESGGRLVTPGTPLTLTCTASGFTIGRYYMSWVRQAPGKGLEWIGIIYTHGVNPDYASWAKGRFTISRPSTTVDLKITSPTTEDTATYFCARVGGFNDYSDIWGPGTLVTVSS

SEQ ID NO: 843 - protein, 29 aa, Oryctolagus cuniculus
QSLEESGGRLVTPGTPLTLTCTASGFTIG

SEQ ID NO: 844 - protein, 5 aa, Oryctolagus cuniculus
RYYMS

SEQ ID NO: 845 - protein, 14 aa, Oryctolagus cuniculus
WVRQAPGKGLEWIG

SEQ ID NO: 846 - protein, 17 aa, Oryctolagus cuniculus
IIYTHGVNPDYASWAKG

SEQ ID NO: 847 - protein, 30 aa, Oryctolagus cuniculus
RFTISRPSTTVDLKITSPTTEDTATYFCAR

SEQ ID NO: 848 - protein, 10 aa, Oryctolagus cuniculus
VGGFNDYSDI

SEQ ID NO: 849 - protein, 11 aa, Artificial
  Humanized antibody sequence
WGPGTLVTVSS

SEQ ID NO: 850 - protein, 330 aa, Artificial; identical to SEQ ID NO: 10
  Humanized antibody sequence

SEQ ID NO: 851 - DNA, 1338 bp, Artificial
  Humanized antibody sequence
cagtcgctggaggagtccgggggtcgcctggtcacgcctgggacacccctgacactcacctgcacagcctctggattcactatcggtcgctactacatgagctgggtccgccaggctccagggaaggggctggaatggatcggaatcatttatactcatggtgttaacccagactacgcgagctgggcgaaaggccgattcaccatctccagaccctcgaccacggtggatctgaaaatcaccagtccgacaaccgaggacacggccacctatttctgtgccagagtgggtggttttaatgactactctgacatttggggcccaggcaccctggtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 852 - DNA, 348 bp, Artificial
  Humanized antibody sequence
cagtcgctggaggagtccgggggtcgcctggtcacgcctgggacacccctgacactcacctgcacagcctctggattcactatcggtcgctactacatgagctgggtccgccaggctccagggaaggggctggaatggatcggaatcatttatactcatggtgttaacccagactacgcgagctgggcgaaaggccgattcaccatctccagaccctcgaccacggtggatctgaaaatcaccagtccgacaaccgaggacacggccacctatttctgtgccagagtgggtggttttaatgactactctgacatttggggcccaggcaccctggtcaccgtctcgagc

SEQ ID NO: 853 - DNA, 87 bp, Oryctolagus cuniculus
cagtcgctggaggagtccgggggtcgcctggtcacgcctgggacacccctgacactcacctgcacagcctctggattcactatcggt

SEQ ID NO: 854 - DNA, 15 bp, Oryctolagus cuniculus
cgctactacatgagc

SEQ ID NO: 855 - DNA, 42 bp, Oryctolagus cuniculus; identical to SEQ ID NO: 95

SEQ ID NO: 856 - DNA, 51 bp, Oryctolagus cuniculus
atcatttatactcatggtgttaacccagactacgcgagctgggcgaaaggc

SEQ ID NO: 857 - DNA, 90 bp, Oryctolagus cuniculus
cgattcaccatctccagaccctcgaccacggtggatctgaaaatcaccagtccgacaaccgaggacacggccacctatttctgtgccaga

SEQ ID NO: 858 - DNA, 30 bp, Oryctolagus cuniculus
gtgggtggttttaatgactactctgacatt

SEQ ID NO: 859 - DNA, 33 bp, Artificial
  Humanized antibody sequence
tggggcccaggcaccctggtcaccgtctcgagc

SEQ ID NO: 860 - DNA, 990 bp, Artificial; identical to SEQ ID NO: 20
  Humanized antibody sequence

SEQ ID NO: 861 - protein, 217 aa, Artificial
  Humanized antibody sequence
AYDMTQTPASVEVAVGGTVTIKCQASESISTYLAWYQQKPGQPPKLLIYRASTLASGVSSRFKGSGSGTQFTLTISGVECADAATYYCQQGYSYSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 862 - protein, 111 aa, Artificial
  Humanized antibody sequence
AYDMTQTPASVEVAVGGTVTIKCQASESISTYLAWYQQKPGQPPKLLIYRASTLASGVSSRFKGSGSGTQFTLTISGVECADAATYYCQQGYSYSNVDNAFGGGTEVVVKR

SEQ ID NO: 863 - protein, 23 aa, Oryctolagus cuniculus
AYDMTQTPASVEVAVGGTVTIKC

SEQ ID NO: 864 - protein, 11 aa, Oryctolagus cuniculus
QASESISTYLA

SEQ ID NO: 865 - protein, 15 aa, Oryctolagus cuniculus
WYQQKPGQPPKLLIY

SEQ ID NO: 866 - protein, 7 aa, Oryctolagus cuniculus
RASTLAS

SEQ ID NO: 867 - protein, 32 aa, Oryctolagus cuniculus; identical to SEQ ID NO: 547

SEQ ID NO: 868 - protein, 12 aa, Oryctolagus cuniculus
QQGYSYSNVDNA

SEQ ID NO: 869 - protein, 11 aa, Artificial
  Humanized antibody sequence
FGGGTEVVVKR

SEQ ID NO: 870 - protein, 106 aa, Artificial; identical to SEQ ID NO: 30
  Humanized antibody sequence

SEQ ID NO: 871 - DNA, 651 bp, Artificial
  Humanized antibody sequence
gcctatgatatgacccagactccagcctctgtggaggtagctgtgggaggcacagtcaccatcaagtgccaggccagtgagagcattagtacctacttagcctggtatcagcagaaaccagggcagcctcccaagctcctgatctacagggcatccactctggcatctggggtctcatcgcggttcaaaggcagtggatctgggacacagttcactctcaccatcagcggcgtggagtgtgccgatgctgccacttactactgtcaacagggttatagttatagtaatgttgataatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 872 - DNA, 333 bp, Artificial
  Humanized antibody sequence
gcctatgatatgacccagactccagcctctgtggaggtagctgtgggaggcacagtcaccatcaagtgccaggccagtgagagcattagtacctacttagcctggtatcagcagaaaccagggcagcctcccaagctcctgatctacagggcatccactctggcatctggggtctcatcgcggttcaaaggcagtggatctgggacacagttcactctcaccatcagcggcgtggagtgtgccgatgctgccacttactactgtcaacagggttatagttatagtaatgttgataatgctttcggcggagggaccgaggtggtggtcaaacgt

SEQ ID NO: 873 - DNA, 69 bp, Oryctolagus cuniculus; identical to SEQ ID NO: 273

SEQ ID NO: 874 - DNA, 33 bp, Oryctolagus cuniculus
caggccagtgagagcattagtacctacttagcc

SEQ ID NO: 875 - DNA, 45 bp, Oryctolagus cuniculus; identical to SEQ ID NO: 35

SEQ ID NO: 876 - DNA, 21 bp, Oryctolagus cuniculus
agggcatccactctggcatct

SEQ ID NO: 877 - DNA, 96 bp, Oryctolagus cuniculus; identical to SEQ ID NO: 597

SEQ ID NO: 878 - DNA, 36 bp, Oryctolagus cuniculus
caacagggttatagttatagtaatgttgataatgct

SEQ ID NO: 879 - DNA, 33 bp, Artificial; identical to SEQ ID NO: 39
  Humanized antibody sequence

SEQ ID NO: 880 - DNA, 318 bp, Artificial; identical to SEQ ID NO: 80
  Humanized antibody sequence

SEQ ID NO: 881 - protein, 449 aa, Artificial
  Humanized antibody sequence
EVQLVESGGGLVQPGGSLRLSCAASGFTVGRYYMSWVRQAPGKGLEWIGIIYTHGVNPDYASSAKGRFTISRDNSKNTLYLQMNSLRAEDTAVYYCARVGGFNDYSDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 119 aa, Artificial
  Humanized antibody sequence
EVQLVESGGGLVQPGGSLRLSCAASGFTVGRYYMSWVRQAPGKGLEWIGIIYTHGVNPDYASSAKGRFTISRDNSKNTLYLQMNSLRAEDTAVYYCARVGGFNDYSDIWGQGTLVTVSS

SEQ ID NO: 883 - protein, 30 aa, Artificial
  Humanized antibody sequence
EVQLVESGGGLVQPGGSLRLSCAASGFTVG

SEQ ID NO: 884 - protein, 5 aa, Oryctolagus cuniculus
RYYMS

SEQ ID NO: 885 - protein, 14 aa, Artificial
  Humanized antibody sequence
WVRQAPGKGLEWIG

SEQ ID NO: 886 - protein, 17 aa, Artificial
  Humanized antibody sequence
IIYTHGVNPDYASSAKG

SEQ ID NO: 887 - protein, 32 aa, Artificial; identical to SEQ ID NO: 47
  Humanized antibody sequence

SEQ ID NO: 888 - protein, 10 aa, Oryctolagus cuniculus
VGGFNDYSDI

SEQ ID NO: 889 - protein, 11 aa, Artificial
  Humanized antibody sequence
WGQGTLVTVSS

SEQ ID NO: 890 - protein, 330 aa, Artificial; identical to SEQ ID NO: 10
  Humanized antibody sequence

SEQ ID NO: 891 - DNA, 1347 bp, Artificial
  Humanized antibody sequence
gaggtgcagctggtggagtctgggggaggcttggtccagcctggggggtccctgagactctcctgtgcagcctctggattcaccgtcggtcgctactacatgagctgggtccgtcaggctccagggaaggggctggagtggatcggaatcatctatactcatggtgttaacccagactacgcgagcagcgcgaaaggccgattcaccatctccagagacaattccaagaacaccctgtatcttcaaatgaacagcctgagagctgaggacactgctgtgtattactgtgctagagtgggtggtttcaatgactactctgacatttggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 892 - DNA, 357 bp, Artificial
  Humanized antibody sequence
gaggtgcagctggtggagtctgggggaggcttggtccagcctggggggtccctgagactctcctgtgcagcctctggattcaccgtcggtcgctactacatgagctgggtccgtcaggctccagggaaggggctggagtggatcggaatcatctatactcatggtgttaacccagactacgcgagcagcgcgaaaggccgattcaccatctccagagacaattccaagaacaccctgtatcttcaaatgaacagcctgagagctgaggacactgctgtgtattactgtgctagagtgggtggtttcaatgactactctgacatttggggccaagggaccctcgtcaccgtctcgagc

SEQ ID NO: 893 - DNA, 90 bp, Artificial
  Humanized antibody sequence
gaggtgcagctggtggagtctgggggaggcttggtccagcctggggggtccctgagactctcctgtgcagcctctggattcaccgtcggt

SEQ ID NO: 894 - DNA, 15 bp, Oryctolagus cuniculus
cgctactacatgagc

SEQ ID NO: 895 - DNA, 42 bp, Artificial; identical to SEQ ID NO: 775
  Humanized antibody sequence

SEQ ID NO: 896 - DNA, 51 bp, Artificial
  Humanized antibody sequence
atcatctatactcatggtgttaacccagactacgcgagcagcgcgaaaggc

SEQ ID NO: 897 - DNA, 96 bp, Artificial; identical to SEQ ID NO: 57
  Humanized antibody sequence

SEQ ID NO: 898 - DNA, 30 bp, Artificial
  Humanized antibody sequence
gtgggtggtttcaatgactactctgacatt

SEQ ID NO: 899 - DNA, 33 bp, Artificial; identical to SEQ ID NO: 59
  Humanized antibody sequence

SEQ ID NO: 900 - DNA, 990 bp, Artificial; identical to SEQ ID NO: 20
  Humanized antibody sequence

SEQ ID NO: 901 - protein, 217 aa, Artificial
  Humanized antibody sequence
DIQMTQSPSSLSASVGDRVTITCQASESISTYLAWYQQKPGKVPKLLIYRASTLASGVPSRFSGSGSGTDFTLTISSLQPEDVATYYCQQGYSYSNVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 902 - protein, 111 aa, Artificial
  Humanized antibody sequence
DIQMTQSPSSLSASVGDRVTITCQASESISTYLAWYQQKPGKVPKLLIYRASTLASGVPSRFSGSGSGTDFTLTISSLQPEDVATYYCQQGYSYSNVDNAFGGGTKVEIKR

SEQ ID NO: 903 - protein, 23 aa, Artificial
  Humanized antibody sequence
DIQMTQSPSSLSASVGDRVTITC

SEQ ID NO: 904 - protein, 11 aa, Oryctolagus cuniculus
QASESISTYLA

SEQ ID NO: 905 - protein, 15 aa, Artificial
  Humanized antibody sequence
WYQQKPGKVPKLLIY

SEQ ID NO: 906 - protein, 7 aa, Oryctolagus cuniculus
RASTLAS

SEQ ID NO: 907 - protein, 32 aa, Artificial; identical to SEQ ID NO: 787
  Humanized antibody sequence

SEQ ID NO: 908 - protein, 12 aa, Oryctolagus cuniculus
QQGYSYSNVDNA

SEQ ID NO: 909 - protein, 11 aa, Artificial
  Humanized antibody sequence
FGGGTKVEIKR

SEQ ID NO: 910 - protein, 106 aa, Artificial; identical to SEQ ID NO: 30
  Humanized antibody sequence

SEQ ID NO: 911 - DNA, 651 bp, Artificial
  Humanized antibody sequence
gacatccagatgacccagtctccatcctccctgtctgcatctgtaggagacagagtcaccatcacttgccaggccagtgagagcattagtacctacttagcctggtatcagcagaaaccagggaaagttcctaagctcctgatctatagggcatccactctggcatctggggtcccatctcgtttcagtggcagtggatctgggacagatttcactctcaccatcagcagcctgcagcctgaagatgttgcaacttattactgtcaacagggttatagttatagtaatgttgataatgctttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 912 - DNA, 333 bp, Artificial
  Humanized antibody sequence
gacatccagatgacccagtctccatcctccctgtctgcatctgtaggagacagagtcaccatcacttgccaggccagtgagagcattagtacctacttagcctggtatcagcagaaaccagggaaagttcctaagctcctgatctatagggcatccactctggcatctggggtcccatctcgtttcagtggcagtggatctgggacagatttcactctcaccatcagcagcctgcagcctgaagatgttgcaacttattactgtcaacagggttatagttatagtaatgttgataatgctttcggcggaggaaccaaggtggaaatcaaacgt

SEQ ID NO: 913 - DNA, 69 bp, Artificial; identical to SEQ ID NO: 793
  Humanized antibody sequence

SEQ ID NO: 914 - DNA, 33 bp, Oryctolagus cuniculus; identical to SEQ ID NO: 874

SEQ ID NO: 915 - DNA, 45 bp, Artificial; identical to SEQ ID NO: 795
  Humanized antibody sequence

SEQ ID NO: 916 - DNA, 21 bp, Oryctolagus cuniculus
agggcatccactctggcatct

SEQ ID NO: 917 - DNA, 96 bp, Artificial; identical to SEQ ID NO: 797
  Humanized antibody sequence

SEQ ID NO: 918 - DNA, 36 bp, Oryctolagus cuniculus; identical to SEQ ID NO: 878

SEQ ID NO: 919 - DNA, 33 bp, Artificial; identical to SEQ ID NO: 79
  Humanized antibody sequence

SEQ ID NO: 920 - DNA, 318 bp, Artificial; identical to SEQ ID NO: 40
  Humanized antibody sequence

SEQ ID NO: 921 - protein, 448 aa, Artificial
  Humanized antibody sequence
QSLEESGGRLVTPGTPLTLTCTASGFSLSSYAMGWFRQAPGKGLEWIAYIFASGSTYYASWAKGRFTISKTSTTVELKITSLTTEDTATYFCARGSGARFFPNYFAIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 922 - protein, 118 aa, Artificial
  Humanized antibody sequence
QSLEESGGRLVTPGTPLTLTCTASGFSLSSYAMGWFRQAPGKGLEWIAYIFASGSTYYASWAKGRFTISKTSTTVELKITSLTTEDTATYFCARGSGARFFPNYFAIWGPGTLVTVSS

SEQ ID NO: 923 - protein, 29 aa, Oryctolagus cuniculus
QSLEESGGRLVTPGTPLTLTCTASGFSLS

SEQ ID NO: 924 - protein, 5 aa, Oryctolagus cuniculus
SYAMG

SEQ ID NO: 925 - protein, 14 aa, Oryctolagus cuniculus
WFRQAPGKGLEWIA

SEQ ID NO: 926 - protein, 16 aa, Oryctolagus cuniculus
YIFASGSTYYASWAKG

SEQ ID NO: 927 - protein, 30 aa, Oryctolagus cuniculus
RFTISKTSTTVELKITSLTTEDTATYFCAR

SEQ ID NO: 928 - protein, 13 aa, Oryctolagus cuniculus
GSGARFFPNYFAI

SEQ ID NO: 929 - protein, 11 aa, Artificial
  Humanized antibody sequence
WGPGTLVTVSS

SEQ ID NO: 930 - protein, 330 aa, Artificial; identical to SEQ ID NO: 10
  Humanized antibody sequence

SEQ ID NO: 931 - DNA, 1344 bp, Artificial
  Humanized antibody sequence
cagtcgctggaggagtccgggggtcgcctggtcacgcctgggacacccctgacactcacctgcacagcctctggattctccctcagtagctatgcaatgggctggttccgccaggctccagggaaggggctggagtggatcgcatacatttttgctagtggtagcacatactacgcgagctgggcgaaaggccgattcaccatctccaaaacctcgaccacggtggagctgaaaatcaccagtctgacaaccgaggacacggccacctatttctgtgccagaggtagtggtgctcgttttttccccaactactttgccatctggggcccaggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 932 - DNA, 354 bp, Artificial
  Humanized antibody sequence
cagtcgctggaggagtccgggggtcgcctggtcacgcctgggacacccctgacactcacctgcacagcctctggattctccctcagtagctatgcaatgggctggttccgccaggctccagggaaggggctggagtggatcgcatacatttttgctagtggtagcacatactacgcgagctgggcgaaaggccgattcaccatctccaaaacctcgaccacggtggagctgaaaatcaccagtctgacaaccgaggacacggccacctatttctgtgccagaggtagtggtgctcgttttttccccaactactttgccatctggggcccaggcaccctcgtcaccgtctcgagc

SEQ ID NO: 933 - DNA, 87 bp, Oryctolagus cuniculus
cagtcgctggaggagtccgggggtcgcctggtcacgcctgggacacccctgacactcacctgcacagcctctggattctccctcagt

SEQ ID NO: 934 - DNA, 15 bp, Oryctolagus cuniculus
agctatgcaatgggc

SEQ ID NO: 935 - DNA, 42 bp, Oryctolagus cuniculus
tggttccgccaggctccagggaaggggctggagtggatcgca

SEQ ID NO: 936 - DNA, 48 bp, Oryctolagus cuniculus
tacatttttgctagtggtagcacatactacgcgagctgggcgaaaggc

SEQ ID NO: 937 - DNA, 90 bp, Oryctolagus cuniculus
cgattcaccatctccaaaacctcgaccacggtggagctgaaaatcaccagtctgacaaccgaggacacggccacctatttctgtgccaga

SEQ ID NO: 938 - DNA, 39 bp, Oryctolagus cuniculus
ggtagtggtgctcgttttttccccaactactttgccatc

SEQ ID NO: 939 - DNA, 33 bp, Artificial; identical to SEQ ID NO: 179
  Humanized antibody sequence

SEQ ID NO: 940 - DNA, 990 bp, Artificial; identical to SEQ ID NO: 20
  Humanized antibody sequence

SEQ ID NO: 941 - protein, 216 aa, Artificial
  Humanized antibody sequence
QVLTQTASSVSAAVGGTVTISCQSSQSVTNNNDLAWYQQKPGQPPKLLIYQASKLASGVPSRFKGSGSGTQFTLTISDLECDDAATYYCQGSYSGGICAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 942 - protein, 110 aa, Artificial
  Humanized antibody sequence
QVLTQTASSVSAAVGGTVTISCQSSQSVTNNNDLAWYQQKPGQPPKLLIYQASKLASGVPSRFKGSGSGTQFTLTISDLECDDAATYYCQGSYSGGICAFGGGTEVVVKR

SEQ ID NO: 943 - protein, 22 aa, Oryctolagus cuniculus
QVLTQTASSVSAAVGGTVTISC

SEQ ID NO: 944 - protein, 13 aa, Oryctolagus cuniculus
QSSQSVTNNNDLA

SEQ ID NO: 945 - protein, 15 aa, Oryctolagus cuniculus
WYQQKPGQPPKLLIY

SEQ ID NO: 946 - protein, 7 aa, Oryctolagus cuniculus
QASKLAS

SEQ ID NO: 947 - protein, 32 aa, Oryctolagus cuniculus
GVPSRFKGSGSGTQFTLTISDLECDDAATYYC

SEQ ID NO: 948 - protein, 10 aa, Oryctolagus cuniculus
QGSYSGGICA

SEQ ID NO: 949 - protein, 11 aa, Artificial
  Humanized antibody sequence
FGGGTEVVVKR

SEQ ID NO: 950 - protein, 106 aa, Artificial; identical to SEQ ID NO: 30
  Humanized antibody sequence

SEQ ID NO: 951 - DNA, 648 bp, Artificial
  Humanized antibody sequence
caagtgctgacccagactgcatcgtccgtgtctgcagctgtgggaggcacagtcaccatcagttgccagtccagtcagagtgttactaataacaacgacttagcctggtatcagcagaaaccagggcagcctcccaagctcctgatctaccaggcatccaaactggcatctggggtcccatcgcggttcaaaggcagtggatctgggacacagttcactctcaccatcagcgacctggagtgtgacgatgctgccacttactactgtcaaggcagttatagtggtggtatttgtgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 952 - DNA, 330 bp, Artificial
  Humanized antibody sequence
caagtgctgacccagactgcatcgtccgtgtctgcagctgtgggaggcacagtcaccatcagttgccagtccagtcagagtgttactaataacaacgacttagcctggtatcagcagaaaccagggcagcctcccaagctcctgatctaccaggcatccaaactggcatctggggtcccatcgcggttcaaaggcagtggatctgggacacagttcactctcaccatcagcgacctggagtgtgacgatgctgccacttactactgtcaaggcagttatagtggtggtatttgtgctttcggcggagggaccgaggtggtggtcaaacgt

SEQ ID NO: 953 - DNA, 66 bp, Oryctolagus cuniculus
caagtgctgacccagactgcatcgtccgtgtctgcagctgtgggaggcacagtcaccatcagttgc

SEQ ID NO: 954 - DNA, 39 bp, Oryctolagus cuniculus
cagtccagtcagagtgttactaataacaacgacttagcc

SEQ ID NO: 955 - DNA, 45 bp, Oryctolagus cuniculus; identical to SEQ ID NO: 35

SEQ ID NO: 956 - DNA, 21 bp, Oryctolagus cuniculus
caggcatccaaactggcatct

SEQ ID NO: 957 - DNA, 96 bp, Oryctolagus cuniculus
ggggtcccatcgcggttcaaaggcagtggatctgggacacagttcactctcaccatcagcgacctggagtgtgacgatgctgccacttactactgt

SEQ ID NO: 958 - DNA, 30 bp, Oryctolagus cuniculus
caaggcagttatagtggtggtatttgtgct

SEQ ID NO: 959 - DNA, 33 bp, Artificial; identical to SEQ ID NO: 39
  Humanized antibody sequence

SEQ ID NO: 960 - DNA, 318 bp, Artificial; identical to SEQ ID NO: 80
  Humanized antibody sequence

SEQ ID NO: 961 - protein, 449 aa, Artificial
  Humanized antibody sequence
QSVEESGGRLVTPGTPLTLTCTVSGFSLSTYTMNWVRQAPGKGLEYIGFISSSSSIDYVSWAKGRFTISKTSTTVDLKITSPTTEDTATYFCARDFYADYIGGGYPYIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 962 - protein, 119 aa, Artificial
  Humanized antibody sequence
QSVEESGGRLVTPGTPLTLTCTVSGFSLSTYTMNWVRQAPGKGLEYIGFISSSSSIDYVSWAKGRFTISKTSTTVDLKITSPTTEDTATYFCARDFYADYIGGGYPYIWGPGTLVTVSS

SEQ ID NO: 963 - protein, 29 aa, Oryctolagus cuniculus
QSVEESGGRLVTPGTPLTLTCTVSGFSLS

SEQ ID NO: 964 - protein, 5 aa, Oryctolagus cuniculus
TYTMN

SEQ ID NO: 965 - protein, 14 aa, Oryctolagus cuniculus
WVRQAPGKGLEYIG

SEQ ID NO: 966 - protein, 16 aa, Oryctolagus cuniculus
FISSSSSIDYVSWAKG

SEQ ID NO: 967 - protein, 30 aa, Oryctolagus cuniculus; identical to SEQ ID NO: 167

SEQ ID NO: 968 - protein, 14 aa, Oryctolagus cuniculus
DFYADYIGGGYPYI

SEQ ID NO: 969 - protein, 11 aa, Artificial
  Humanized antibody sequence
WGPGTLVTVSS

SEQ ID NO: 970 - protein, 330 aa, Artificial; identical to SEQ ID NO: 10
  Humanized antibody sequence

SEQ ID NO: 971 - DNA, 1347 bp, Artificial
  Humanized antibody sequence
cagtcggtggaggagtccgggggtcgcctggtcacgcctgggacacccctgacactcacctgcacagtctctggattctccctcagtacctatacaatgaactgggtccgccaggctccagggaaggggctggaatacatcggattcattagtagtagtagtagcatagattatgtgagttgggcgaaaggccgattcaccatctccaaaacctcgaccacggtggatctgaaaatcaccagtccgacaaccgaggacacggccacctatttctgtgccagagatttttatgctgattatattggtggtggttatccttacatctggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 972 - DNA, 357 bp, Artificial
  Humanized antibody sequence
cagtcggtggaggagtccgggggtcgcctggtcacgcctgggacacccctgacactcacctgcacagtctctggattctccctcagtacctatacaatgaactgggtccgccaggctccagggaaggggctggaatacatcggattcattagtagtagtagtagcatagattatgtgagttgggcgaaaggccgattcaccatctccaaaacctcgaccacggtggatctgaaaatcaccagtccgacaaccgaggacacggccacctatttctgtgccagagatttttatgctgattatattggtggtggttatccttacatctggggcccgggcaccctcgtcaccgtctcgagc

SEQ ID NO: 973 - DNA, 87 bp, Oryctolagus cuniculus; identical to SEQ ID NO: 13

SEQ ID NO: 974 - DNA, 15 bp, Oryctolagus cuniculus
acctatacaatgaac

SEQ ID NO: 975 - DNA, 42 bp, Oryctolagus cuniculus; identical to SEQ ID NO: 615

SEQ ID NO: 976 - DNA, 48 bp, Oryctolagus cuniculus
ttcattagtagtagtagtagcatagattatgtgagttgggcgaaaggc

SEQ ID NO: 977 - DNA, 90 bp, Oryctolagus cuniculus; identical to SEQ ID NO: 537

SEQ ID NO: 978 - DNA, 42 bp, Oryctolagus cuniculus
gatttttatgctgattatattggtggtggttatccttacatc

SEQ ID NO: 979 - DNA, 33 bp, Artificial; identical to SEQ ID NO: 219
  Humanized antibody sequence

SEQ ID NO: 980 - DNA, 990 bp, Artificial; identical to SEQ ID NO: 20
  Humanized antibody sequence

SEQ ID NO: 981 - protein, 216 aa, Artificial
  Humanized antibody sequence
ADVVMTQTPASVSEPVGGTVTIKCQASQSISSYLSWYQQKPGQPPKLLIYGASKLTSGVPSRFKGSGSGTEYTLTISDLECADAATYYCQSNYDIYSYAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 982 - protein, 110 aa, Artificial
  Humanized antibody sequence
ADVVMTQTPASVSEPVGGTVTIKCQASQSISSYLSWYQQKPGQPPKLLIYGASKLTSGVPSRFKGSGSGTEYTLTISDLECADAATYYCQSNYDIYSYAFGGGTEVVVKR

SEQ ID NO: 983 - protein, 24 aa, Oryctolagus cuniculus
ADVVMTQTPASVSEPVGGTVTIKC

SEQ ID NO: 984 - protein, 11 aa, Oryctolagus cuniculus
QASQSISSYLS

SEQ ID NO: 985 - protein, 15 aa, Oryctolagus cuniculus
WYQQKPGQPPKLLIY

SEQ ID NO: 986 - protein, 7 aa, Oryctolagus cuniculus
GASKLTS

SEQ ID NO: 987 - protein, 32 aa, Oryctolagus cuniculus; identical to SEQ ID NO: 747

SEQ ID NO: 988 - protein, 10 aa, Oryctolagus cuniculus
QSNYDIYSYA

SEQ ID NO: 989 - protein, 11 aa, Artificial
  Humanized antibody sequence
FGGGTEVVVKR

SEQ ID NO: 990 - protein, 106 aa, Artificial; identical to SEQ ID NO: 30
  Humanized antibody sequence

SEQ ID NO: 991 - DNA, 648 bp, Artificial
  Humanized antibody sequence
gccgatgttgtgatgacccagactccagcctccgtgtctgaacctgtgggaggcacagtcaccatcaagtgccaggccagtcagagcattagtagctacttatcctggtatcagcagaaaccagggcagcctcccaagctcctgatctatggtgcatccaaactgacatctggggtcccatcgcggttcaaaggcagtggatctgggacagagtacactctcaccatcagcgacctggagtgtgccgatgctgccacttactactgtcaaagcaattatgatatttatagttatgctttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 992 - DNA, 330 bp, Artificial
  Humanized antibody sequence
gccgatgttgtgatgacccagactccagcctccgtgtctgaacctgtgggaggcacagtcaccatcaagtgccaggccagtcagagcattagtagctacttatcctggtatcagcagaaaccagggcagcctcccaagctcctgatctatggtgcatccaaactgacatctggggtcccatcgcggttcaaaggcagtggatctgggacagagtacactctcaccatcagcgacctggagtgtgccgatgctgccacttactactgtcaaagcaattatgatatttatagttatgctttcggcggagggaccgaggtggtggtcaaacgt

SEQ ID NO: 993 - DNA, 72 bp, Oryctolagus cuniculus
gccgatgttgtgatgacccagactccagcctccgtgtctgaacctgtgggaggcacagtcaccatcaagtgc

SEQ ID NO: 994 - DNA, 33 bp, Oryctolagus cuniculus
caggccagtcagagcattagtagctacttatcc

SEQ ID NO: 995 - DNA, 45 bp, Oryctolagus cuniculus; identical to SEQ ID NO: 195

SEQ ID NO: 996 - DNA, 21 bp, Oryctolagus cuniculus
ggtgcatccaaactgacatct

SEQ ID NO: 997 - DNA, 96 bp, Oryctolagus cuniculus; identical to SEQ ID NO: 757

SEQ ID NO: 998 - DNA, 30 bp, Oryctolagus cuniculus
caaagcaattatgatatttatagttatgct

SEQ ID NO: 999 - DNA, 33 bp, Artificial; identical to SEQ ID NO: 39
  Humanized antibody sequence

SEQ ID NO: 1000 - DNA, 318 bp, Artificial; identical to SEQ ID NO: 80
  Humanized antibody sequence

SEQ ID NO: 1001 - protein, 453 aa, Artificial
  Humanized antibody sequence
QSLEESGGDLVKPGGTLTLTCTASGFSFSDDHYMCWVRQAPGKGLQWIACMYVGSSGATYYASWAKGRFTISKTSSTTVTLQMTSLTAADTATYFCARDDWTSYYAWGYWALWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1002 - protein, 123 aa, Artificial
  Humanized antibody sequence
QSLEESGGDLVKPGGTLTLTCTASGFSFSDDHYMCWVRQAPGKGLQWIACMYVGSSGATYYASWAKGRFTISKTSSTTVTLQMTSLTAADTATYFCARDDWTSYYAWGYWALWGPGTLVTVSS

SEQ ID NO: 1003 - protein, 29 aa, Oryctolagus cuniculus
QSLEESGGDLVKPGGTLTLTCTASGFSFS

SEQ ID NO: 1004 - protein, 6 aa, Oryctolagus cuniculus
DDHYMC

SEQ ID NO: 1005 - protein, 14 aa, Oryctolagus cuniculus
WVRQAPGKGLQWIA

SEQ ID NO: 1006 - protein, 18 aa, Oryctolagus cuniculus
CMYVGSSGATYYASWAKG

SEQ ID NO: 1007 - protein, 31 aa, Oryctolagus cuniculus
RFTISKTSSTTVTLQMTSLTAADTATYFCAR

SEQ ID NO: 1008 - protein, 14 aa, Oryctolagus cuniculus
DDWTSYYAWGYWAL

SEQ ID NO: 1009 - protein, 11 aa, Artificial
  Humanized antibody sequence
WGPGTLVTVSS

SEQ ID NO: 1010 - protein, 330 aa, Artificial; identical to SEQ ID NO: 10
  Humanized antibody sequence

SEQ ID NO: 1011 - DNA, 1359 bp, Artificial
  Humanized antibody sequence
cagtcgttggaggagtccgggggagacctggtcaagcctggaggaaccctgacactcacctgcacagcctctggattctccttcagtgacgaccactacatgtgctgggtccgccaggctccagggaaggggctgcagtggatcgcatgcatgtatgttggtagtagtggtgccacttattacgcgagctgggcgaaaggccgattcaccatctccaaaacctcgtcgaccacggtgactctgcaaatgaccagtctgacagccgcggacacggccacctatttctgtgcgagagatgattggactagttattatgcgtgggggtattgggccttgtggggcccgggcaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1012 - DNA, 369 bp, Artificial
  Humanized antibody sequence
cagtcgttggaggagtccgggggagacctggtcaagcctggaggaaccctgacactcacctgcacagcctctggattctccttcagtgacgaccactacatgtgctgggtccgccaggctccagggaaggggctgcagtggatcgcatgcatgtatgttggtagtagtggtgccacttattacgcgagctgggcgaaaggccgattcaccatctccaaaacctcgtcgaccacggtgactctgcaaatgaccagtctgacagccgcggacacggccacctatttctgtgcgagagatgattggactagttattatgcgtgggggtattgggccttgtggggcccgggcaccctcgtcaccgtctcgagc

SEQ ID NO: 1013 - DNA, 87 bp, Oryctolagus cuniculus
cagtcgttggaggagtccgggggagacctggtcaagcctggaggaaccctgacactcacctgcacagcctctggattctccttcagt

SEQ ID NO: 1014 - DNA, 18 bp, Oryctolagus cuniculus
gacgaccactacatgtgc

SEQ ID NO: 1015 - DNA, 42 bp, Oryctolagus cuniculus
tgggtccgccaggctccagggaaggggctgcagtggatcgca

SEQ ID NO: 1016 - DNA, 54 bp, Oryctolagus cuniculus
tgcatgtatgttggtagtagtggtgccacttattacgcgagctgggcgaaaggc

SEQ ID NO: 1017 - DNA, 93 bp, Oryctolagus cuniculus
cgattcaccatctccaaaacctcgtcgaccacggtgactctgcaaatgaccagtctgacagccgcggacacggccacctatttctgtgcgaga

SEQ ID NO: 1018 - DNA, 42 bp, Oryctolagus cuniculus
gatgattggactagttattatgcgtgggggtattgggccttg

SEQ ID NO: 1019 - DNA, 33 bp, Artificial; identical to SEQ ID NO: 219
  Humanized antibody sequence

SEQ ID NO: 1020 - DNA, 990 bp, Artificial; identical to SEQ ID NO: 20
  Humanized antibody sequence

SEQ ID NO: 1021 - protein, 218 aa, Artificial
  Humanized antibody sequence
ADIVMTQNPASVSEPVGGTVTIKCQASQSVNSWLSWYQQKPGQPPKFLIYKASTLASGVSSRFKGSGIGTEFTLTISDLECADAATYYCQFSNSGTIYGSGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1022 - protein, 112 aa, Artificial
  Humanized antibody sequence
ADIVMTQNPASVSEPVGGTVTIKCQASQSVNSWLSWYQQKPGQPPKFLIYKASTLASGVSSRFKGSGIGTEFTLTISDLECADAATYYCQFSNSGTIYGSGFGGGTEVVVKR

SEQ ID NO: 1023 - protein, 24 aa, Oryctolagus cuniculus
ADIVMTQNPASVSEPVGGTVTIKC

SEQ ID NO: 1024 - protein, 11 aa, Oryctolagus cuniculus
QASQSVNSWLS

SEQ ID NO: 1025 - protein, 15 aa, Oryctolagus cuniculus
WYQQKPGQPPKFLIY

SEQ ID NO: 1026 - protein, 7 aa, Oryctolagus cuniculus
KASTLAS

SEQ ID NO: 1027 - protein, 32 aa, Oryctolagus cuniculus
GVSSRFKGSGIGTEFTLTISDLECADAATYYC

SEQ ID NO: 1028 - protein, 12 aa, Oryctolagus cuniculus
QFSNSGTIYGSG

SEQ ID NO: 1029 - protein, 11 aa, Artificial
  Humanized antibody sequence
FGGGTEVVVKR

SEQ ID NO: 1030 - protein, 106 aa, Artificial; identical to SEQ ID NO: 30
  Humanized antibody sequence

SEQ ID NO: 1031 - DNA, 654 bp, Artificial
  Humanized antibody sequence
gctgacattgtgatgacccagaatccagcctccgtgtctgaacctgtgggaggcacagtcaccatcaagtgccaggccagtcagagcgttaatagttggttatcctggtatcagcagaaaccagggcagcctcccaagttcctgatctacaaggcatccactctggcatctggggtctcatcgcggttcaaaggcagtgggattgggacagagttcactctcaccatcagcgacctggagtgtgccgatgctgccacgtactattgccaatttagtaatagtggtactatttatgggagtggtttcggcggagggaccgaggtggtggtcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1032 - DNA, 336 bp, Artificial
  Humanized antibody sequence
gctgacattgtgatgacccagaatccagcctccgtgtctgaacctgtgggaggcacagtcaccatcaagtgccaggccagtcagagcgttaatagttggttatcctggtatcagcagaaaccagggcagcctcccaagttcctgatctacaaggcatccactctggcatctggggtctcatcgcggttcaaaggcagtgggattgggacagagttcactctcaccatcagcgacctggagtgtgccgatgctgccacgtactattgccaatttagtaatagtggtactatttatgggagtggtttcggcggagggaccgaggtggtggtcaaacgt

SEQ ID NO: 1033 - DNA, 72 bp, Oryctolagus cuniculus
gctgacattgtgatgacccagaatccagcctccgtgtctgaacctgtgggaggcacagtcaccatcaagtgc

SEQ ID NO: 1034 - DNA, 33 bp, Oryctolagus cuniculus
caggccagtcagagcgttaatagttggttatcc

SEQ ID NO: 1035 - DNA, 45 bp, Oryctolagus cuniculus
tggtatcagcagaaaccagggcagcctcccaagttcctgatctac

SEQ ID NO: 1036 - DNA, 21 bp, Oryctolagus cuniculus
aaggcatccactctggcatct

SEQ ID NO: 1037 - DNA, 96 bp, Oryctolagus cuniculus
ggggtctcatcgcggttcaaaggcagtgggattgggacagagttcactctcaccatcagcgacctggagtgtgccgatgctgccacgtactattgc

SEQ ID NO: 1038 - DNA, 36 bp, Oryctolagus cuniculus
caatttagtaatagtggtactatttatgggagtggt

SEQ ID NO: 1039 - DNA, 33 bp, Artificial; identical to SEQ ID NO: 39
  Humanized antibody sequence

SEQ ID NO: 1040 - DNA, 318 bp, Artificial; identical to SEQ ID NO: 80
  Humanized antibody sequence

SEQ ID NO: 1041 - protein, 449 aa, Artificial
  Humanized antibody sequence
EVQLVESGGGLVQPGGSLRLSCAASGFTVSSNAISWVRQAPGKGLEWVGVIYVIGVTDYASSAQGRFTISRDNSKNTLYLQMNSLRAEDTAVYYCARVYDSGWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1042 - protein, 119 aa, Artificial; identical to SEQ ID NO: 282
  Humanized antibody sequence

SEQ ID NO: 1043 - protein, 30 aa, Artificial; identical to SEQ ID NO: 43
  Humanized antibody sequence

SEQ ID NO: 1044 - protein, 5 aa, Oryctolagus cuniculus
SNAIS

SEQ ID NO: 1045 - protein, 14 aa, Artificial
  Humanized antibody sequence
WVRQAPGKGLEWVG

SEQ ID NO: 1046 - protein, 16 aa, Artificial
  Humanized antibody sequence
VIYVIGVTDYASSAQG

SEQ ID NO: 1047 - protein, 32 aa, Artificial; identical to SEQ ID NO: 47
  Humanized antibody sequence

SEQ ID NO: 1048 - protein, 11 aa, Oryctolagus cuniculus
VYDSGWNHFNL

SEQ ID NO: 1049 - protein, 11 aa, Artificial
  Humanized antibody sequence
WGQGTLVTVSS

SEQ ID NO: 1050 - protein, 330 aa, Artificial
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1051 - DNA, 1347 bp, Artificial
  Humanized antibody sequence
gaggtgcagctggtggagtctgggggaggcttggtccagcctggggggtccctgagactctcctgtgcagcctctggattcaccgtcagtagcaatgcaataagctgggtccgtcaggctccagggaaggggctggagtgggtcggagtcatttatgttattggtgtcactgactacgcgagctctgcgcaaggccgattcaccatctccagagacaattccaagaacaccctgtatcttcaaatgaacagcctgagagctgaggacactgctgtgtattactgtgctagagtttatgattctggctggaatcactttaacttgtggggccaagggaccctcgtcaccgtctcgagcgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1052 - DNA, 357 bp, Artificial; identical to SEQ ID NO: 292
  Humanized antibody sequence

SEQ ID NO: 1053 - DNA, 90 bp, Artificial; identical to SEQ ID NO: 53
  Humanized antibody sequence

SEQ ID NO: 1054 - DNA, 15 bp, Oryctolagus cuniculus
agcaatgcaataagc

SEQ ID NO: 1055 - DNA, 42 bp, Artificial; identical to SEQ ID NO: 135
  Humanized antibody sequence

SEQ ID NO: 1056 - DNA, 48 bp, Artificial; identical to SEQ ID NO: 296
  Humanized antibody sequence

SEQ ID NO: 1057 - DNA, 96 bp, Artificial; identical to SEQ ID NO: 57
  Humanized antibody sequence

SEQ ID NO: 1058 - DNA, 33 bp, Oryctolagus cuniculus; identical to SEQ ID NO: 218

SEQ ID NO: 1059 - DNA, 33 bp, Artificial; identical to SEQ ID NO: 59
  Humanized antibody sequence

SEQ ID NO: 1060 - DNA, 990 bp, Artificial
  Humanized antibody sequence
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacgcgagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacgccagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1061 - protein, 217 aa, Artificial; identical to SEQ ID NO: 301
  Humanized antibody sequence

SEQ ID NO: 1062 - protein, 111 aa, Artificial; identical to SEQ ID NO: 302
  Humanized antibody sequence

SEQ ID NO: 1063 - protein, 23 aa, Artificial
  Humanized antibody sequence
DIQMTQSPSTLSASVGDRVTITC

SEQ ID NO: 1064 - protein, 11 aa, Oryctolagus cuniculus
QASQSISSWLA

SEQ ID NO: 1065 - protein, 15 aa, Artificial
  Humanized antibody sequence
WYQQKPGKAPKLLIY

SEQ ID NO: 1066 - protein, 7 aa, Oryctolagus cuniculus
EASKLAS

SEQ ID NO: 1067 - protein, 32 aa, Artificial; identical to SEQ ID NO: 67
  Humanized antibody sequence

SEQ ID NO: 1068 - protein, 12 aa, Oryctolagus cuniculus
QQAYSVANVDNA

SEQ ID NO: 1069 - protein, 11 aa, Artificial
  Humanized antibody sequence
FGGGTKVEIKR

SEQ ID NO: 1070 - protein, 106 aa, Artificial; identical to SEQ ID NO: 30
  Humanized antibody sequence

SEQ ID NO: 1071 - DNA, 651 bp, Artificial
  Humanized antibody sequence
gacatccagatgacccagtctccttccaccctgtctgcatctgtaggagacagagtcaccatcacttgccaggccagtcagagcattagcagttggttagcctggtatcagcagaaaccaggaaaagcccctaagctcctgatctatgaagcatccaaactggcatctggagtcccatcaaggttcagcggcagtggatctggaacagaattcactctcaccatcagcagcctgcagcctgatgattttgcaacttattactgccaacaggcttatagtgttgccaatgttgataatgctttcggcggaggaaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1072 - DNA, 333 bp, Artificial; identical to SEQ ID NO: 312
  Humanized antibody sequence

SEQ ID NO: 1073 - DNA, 69 bp, Artificial; identical to SEQ ID NO: 73
  Humanized antibody sequence

SEQ ID NO: 1074 - DNA, 33 bp, Oryctolagus cuniculus; identical to SEQ ID NO: 34

SEQ ID NO: 1075 - DNA, 45 bp, Artificial; identical to SEQ ID NO: 75
  Humanized antibody sequence

SEQ ID NO: 1076 - DNA, 21 bp, Oryctolagus cuniculus
gaagcatccaaactggcatct

SEQ ID NO: 1077 - DNA, 96 bp, Artificial; identical to SEQ ID NO: 77
  Humanized antibody sequence

SEQ ID NO: 1078 - DNA, 36 bp, Oryctolagus cuniculus; identical to SEQ ID NO: 278

SEQ ID NO: 1079 - DNA, 33 bp, Artificial; identical to SEQ ID NO: 79
  Humanized antibody sequence

SEQ ID NO: 1080 - DNA, 318 bp, Artificial; identical to SEQ ID NO: 40
  Humanized antibody sequence

What is claimed is:

1. An anti-human hepatocyte growth factor (anti-human HGF) antibody or antibody fragment comprising
    a variable heavy chain comprising the CDR1 sequence of SEQ ID NO: 44, the CDR2 sequence of SEQ ID NO: 46, and the CDR3 sequence of SEQ ID NO: 48; and a variable light chain comprising the CDR1 sequence of SEQ ID NO: 64, the CDR2 sequence of SEQ ID NO: 66, and the CDR3 sequence of SEQ ID NO: 68.

2. The anti-human HGF antibody or antibody fragment of claim 1 comprising:
    (i) a chimeric, humanized, or human antibody or antibody fragment;
    (ii) an scFv fragment, Fab fragment, Fab' fragment, F(ab')2 fragment or a monovalent antibody fragment;
    (iii) an antibody or antibody fragment that substantially or entirely lacks N-glycosylation and/or O-glycosylation;
    (iv) an antibody or antibody fragment which comprises a human constant domain;
    (v) an antibody which contains human IgG1, IgG2, IgG3, or IgG4 antibody constant regions;
    (vi) an antibody or antibody fragment which comprises an Fc region that has been modified to alter at least one of effector function, half-life, proteolysis, or glycosylation;
    (vii) an antibody which contains an Fc region which contains one or more mutations that alters or eliminates N- and/or O-glycosylation;
    (viii) an antibody or antibody fragment which is directly or indirectly attached to a detectable label or therapeutic agent;
    (ix) an antibody or antibody fragment which when administered to a human subject inhibits or neutralizes at least one biological effect elicited by HGF;
    (x) an antibody or antibody fragment which binds to HGF with a $K_D$ that is less than about 100 nM; or
    (xi) an antibody or antibody fragment which is attached to one or more detectable moieties selected from a fluorescent dye, enzyme, substrate, bioluminescent material, radioactive material, chemiluminescent moiety, or mixtures thereof.

3. The anti-human HGF antibody or antibody fragment of claim 1 comprising a variable heavy chain and a variable light chain that are each at least 90% identical to the variable heavy and light chains of SEQ ID NO: 42 and SEQ ID NO: 62, respectively.

4. The antibody or antibody fragments of claim 3 comprising human IgG1, IgG2, IgG3 or IgG4 constant regions.

5. The antibody or antibody fragment of claim 3, comprising the heavy chain of SEQ ID NO: 41 and the light chain of SEQ ID NO: 61.

6. The anti-human HGF antibody or antibody fragment of claim 1 comprising a variable heavy chain and a variable light chain that are each at least 95% identical to the variable heavy and light chains of SEQ ID NO: 42 and SEQ ID NO: 62, respectively.

7. The antibody or antibody fragment of claim 1 comprising
    a variable heavy chain and a variable light chain that are each at least 96% identical to the variable heavy and light chains of SEQ ID NO: 42 and SEQ ID NO: 62, respectively.

8. The antibody or antibody fragment of claim 1,
    a variable heavy chain and a variable light chain that are each at least 97% identical to the variable heavy and light chains of SEQ ID NO: 42 and SEQ ID NO: 62, respectively.

9. The antibody or antibody fragment of claim 1,
    a variable heavy chain and a variable light chain that are each at least 98% identical to the variable heavy and light chains of SEQ ID NO: 42 and SEQ ID NO: 62, respectively.

10. The antibody or antibody fragment of claim 1 comprising
a variable heavy chain and a variable light chain that are each at least 99% identical to the variable heavy and light chains of SEQ ID NO: 42 and SEQ ID NO: 62, respectively.

11. The antibody or antibody fragment of claim 1 comprising
the variable heavy chain and the variable light chain of SEQ ID NO: 42 and SEQ ID NO: 62, respectively.

* * * * *